United States Patent 12,188,016 (ANTISENSE OLIGONUCLEOTIDES FOR MODULATING THE FUNCTION OF A T CELL) - sequence listing, part 4

SEQ ID NO: 70036 - RNA, 21 nt, Artificial Sequence
  Synthetic Oligonucleotide; PD-1 target exon 3; Set C
gaugacggccaggacccagac

SEQ ID NO: 70037 - RNA, 26 nt, Artificial Sequence
  Synthetic Oligonucleotide; PD-1 target exon 3; Set C
gcagaugacggccaggacccagacua

SEQ ID NO: 70038 - RNA, 22 nt, Artificial Sequence
  Synthetic Oligonucleotide; PD-1 target exon 3; Set C
agaugacggccaggacccagac

SEQ ID NO: 70039 - RNA, 24 nt, Artificial Sequence
  Synthetic Oligonucleotide; PD-1 target exon 3; Set C
cagaugacggccaggacccagacu

SEQ ID NO: 70040 - RNA, 27 nt, Artificial Sequence
  Synthetic Oligonucleotide; PD-1 target exon 3; Set C
agcagaugacggccaggacccagacua

SEQ ID NO: 70041 - RNA, 23 nt, Artificial Sequence
  Synthetic Oligonucleotide; PD-1 target exon 3; Set C
cagaugacggccaggacccagac

SEQ ID NO: 70042 - RNA, 25 nt, Artificial Sequence
  Synthetic Oligonucleotide; PD-1 target exon 3; Set C
gcagaugacggccaggacccagacu

SEQ ID NO: 70043 - RNA, 28 nt, Artificial Sequence
  Synthetic Oligonucleotide; PD-1 target exon 3; Set C
gagcagaugacggccaggacccagacua

SEQ ID NO: 70044 - RNA, 26 nt, Artificial Sequence
  Synthetic Oligonucleotide; PD-1 target exon 3; Set C
agcagaugacggccaggacccagacu

SEQ ID NO: 70045 - RNA, 24 nt, Artificial Sequence
  Synthetic Oligonucleotide; PD-1 target exon 3; Set C
gcagaugacggccaggacccagac

SEQ ID NO: 70046 - RNA, 25 nt, Artificial Sequence
  Synthetic Oligonucleotide; PD-1 target exon 3; Set C
agcagaugacggccaggacccagac

SEQ ID NO: 70047 - RNA, 27 nt, Artificial Sequence
  Synthetic Oligonucleotide; PD-1 target exon 3; Set C
gagcagaugacggccaggacccagacu

SEQ ID NO: 70048 - RNA, 28 nt, Artificial Sequence
  Synthetic Oligonucleotide; PD-1 target exon 3; Set C
ggagcagaugacggccaggacccagacu

SEQ ID NO: 70049 - RNA, 26 nt, Artificial Sequence
  Synthetic Oligonucleotide; PD-1 target exon 3; Set C
gagcagaugacggccaggacccagac

SEQ ID NO: 70050 - RNA, 29 nt, Artificial Sequence
  Synthetic Oligonucleotide; PD-1 target exon 3; Set C
gggagcagaugacggccaggacccagacu

SEQ ID NO: 70051 - RNA, 27 nt, Artificial Sequence
  Synthetic Oligonucleotide; PD-1 target exon 3; Set C
ggagcagaugacggccaggacccagac

SEQ ID NO: 70052 - RNA, 15 nt, Artificial Sequence
  Synthetic Oligonucleotide; PD-1 target exon 3; Set C
gaugacggccaggac

SEQ ID NO: 70053 - RNA, 28 nt, Artificial Sequence
  Synthetic Oligonucleotide; PD-1 target exon 3; Set C
gggagcagaugacggccaggacccagac

SEQ ID NO: 70054 - RNA, 16 nt, Artificial Sequence
  Synthetic Oligonucleotide; PD-1 target exon 3; Set C
agaugacggccaggac

SEQ ID NO: 70055 - RNA, 17 nt, Artificial Sequence
  Synthetic Oligonucleotide; PD-1 target exon 3; Set B
cagaugacggccaggac

SEQ ID NO: 70056 - RNA, 18 nt, Artificial Sequence
  Synthetic Oligonucleotide; PD-1 target exon 3; Set B
gcagaugacggccaggac

SEQ ID NO: 70057 - RNA, 19 nt, Artificial Sequence
  Synthetic Oligonucleotide; PD-1 target exon 3; Set B
agcagaugacggccaggac

SEQ ID NO: 70058 - RNA, 20 nt, Artificial Sequence
  Synthetic Oligonucleotide; PD-1 target exon 3; Set B
gagcagaugacggccaggac

SEQ ID NO: 70059 - RNA, 21 nt, Artificial Sequence
  Synthetic Oligonucleotide; PD-1 target exon 3; Set C
ggagcagaugacggccaggac

SEQ ID NO: 70060 - RNA, 22 nt, Artificial Sequence
  Synthetic Oligonucleotide; PD-1 target exon 3; Set C
gggagcagaugacggccaggac

SEQ ID NO: 70061 - RNA, 15 nt, Artificial Sequence
  Synthetic Oligonucleotide; PD-1 target exon 3; Set C
gggagcagaugacgg

SEQ ID NO: 70062 - RNA, 38 nt, Artificial Sequence
  Synthetic Oligonucleotide; PD-1 target exon 3; Set C
uuaccucgugcggcccgggagcagaugacggccaggac

SEQ ID NO: 70063 - RNA, 37 nt, Artificial Sequence
  Synthetic Oligonucleotide; PD-1 target exon 3; Set C
uuaccucgugcggcccgggagcagaugacggccagga

SEQ ID NO: 70064 - RNA, 39 nt, Artificial Sequence
  Synthetic Oligonucleotide; PD-1 target exon 3; Set C
guuaccucgugcggcccgggagcagaugacggccaggac

SEQ ID NO: 70065 - RNA, 40 nt, Artificial Sequence
  Synthetic Oligonucleotide; PD-1 target exon 3; Set C
cguuaccucgugcggcccgggagcagaugacggccaggac

SEQ ID NO: 70066 - RNA, 21 nt, Artificial Sequence
  Synthetic Oligonucleotide; PD-1 target exon 3; Set C
ccucgugcggcccgggagcag

SEQ ID NO: 70067 - RNA, 20 nt, Artificial Sequence
  Synthetic Oligonucleotide; PD-1 target exon 3; Set C
ccucgugcggcccgggagca

SEQ ID NO: 70068 - RNA, 19 nt, Artificial Sequence
  Synthetic Oligonucleotide; PD-1 target exon 3; Set C
ccucgugcggcccgggagc

SEQ ID NO: 70069 - RNA, 21 nt, Artificial Sequence
  Synthetic Oligonucleotide; PD-1 target exon 3; Set C
accucgugcggcccgggagca

SEQ ID NO: 70070 - RNA, 20 nt, Artificial Sequence
  Synthetic Oligonucleotide; PD-1 target exon 3; Set C
accucgugcggcccgggagc

SEQ ID NO: 70071 - RNA, 18 nt, Artificial Sequence
  Synthetic Oligonucleotide; PD-1 target exon 3; Set C
ccucgugcggcccgggag

SEQ ID NO: 70072 - RNA, 17 nt, Artificial Sequence
  Synthetic Oligonucleotide; PD-1 target exon 3; Set C
ccucgugcggcccggga

SEQ ID NO: 70073 - RNA, 21 nt, Artificial Sequence
  Synthetic Oligonucleotide; PD-1 target exon 3; Set C
uaccucgugcggcccgggagc

SEQ ID NO: 70074 - RNA, 19 nt, Artificial Sequence
  Synthetic Oligonucleotide; PD-1 target exon 3; Set C
accucgugcggcccgggag

SEQ ID NO: 70075 - RNA, 16 nt, Artificial Sequence
  Synthetic Oligonucleotide; PD-1 target exon 3; Set C
ccucgugcggcccggg

SEQ ID NO: 70076 - RNA, 18 nt, Artificial Sequence
  Synthetic Oligonucleotide; PD-1 target exon 3; Set C
accucgugcggcccggga

SEQ ID NO: 70077 - RNA, 20 nt, Artificial Sequence
  Synthetic Oligonucleotide; PD-1 target exon 3; Set C
uaccucgugcggcccgggag

SEQ ID NO: 70078 - RNA, 17 nt, Artificial Sequence
  Synthetic Oligonucleotide; PD-1 target exon 3; Set C
accucgugcggcccggg

SEQ ID NO: 70079 - RNA, 19 nt, Artificial Sequence
  Synthetic Oligonucleotide; PD-1 target exon 3; Set C
uaccucgugcggcccggga

SEQ ID NO: 70080 - RNA, 18 nt, Artificial Sequence
  Synthetic Oligonucleotide; PD-1 target exon 3; Set C
uaccucgugcggcccggg

SEQ ID NO: 70081 - RNA, 15 nt, Artificial Sequence
  Synthetic Oligonucleotide; PD-1 target exon 3; Set C
ggaugacguuaccuc

SEQ ID NO: 70082 - RNA, 16 nt, Artificial Sequence
  Synthetic Oligonucleotide; PD-1 target exon 3; Set C
gggaugacguuaccuc

SEQ ID NO: 70083 - RNA, 17 nt, Artificial Sequence
  Synthetic Oligonucleotide; PD-1 target exon 3; Set C
ugggaugacguuaccuc

SEQ ID NO: 70084 - RNA, 18 nt, Artificial Sequence
  Synthetic Oligonucleotide; PD-1 target exon 3; Set C
cugggaugacguuaccuc

SEQ ID NO: 70085 - RNA, 19 nt, Artificial Sequence
  Synthetic Oligonucleotide; PD-1 target exon 3; Set B
gcugggaugacguuaccuc

SEQ ID NO: 70086 - RNA, 20 nt, Artificial Sequence
  Synthetic Oligonucleotide; PD-1 target exon 3; Set B
ggcugggaugacguuaccuc

SEQ ID NO: 70087 - RNA, 20 nt, Artificial Sequence
  Synthetic Oligonucleotide; PD-1 target exon 3; Set B
gggcugggaugacguuaccu

SEQ ID NO: 70088 - RNA, 21 nt, Artificial Sequence
  Synthetic Oligonucleotide; PD-1 target exon 3; Set C
ggggcugggaugacguuaccu

SEQ ID NO: 70089 - RNA, 19 nt, Artificial Sequence
  Synthetic Oligonucleotide; PD-1 target exon 3; Set B
gggcugggaugacguuacc

SEQ ID NO: 70090 - RNA, 18 nt, Artificial Sequence
  Synthetic Oligonucleotide; PD-1 target exon 3; Set B
gggcugggaugacguuac

SEQ ID NO: 70091 - RNA, 22 nt, Artificial Sequence
  Synthetic Oligonucleotide; PD-1 target exon 3; Set C
aggggcugggaugacguuaccu

SEQ ID NO: 70092 - RNA, 20 nt, Artificial Sequence
  Synthetic Oligonucleotide; PD-1 target exon 3; Set B
ggggcugggaugacguuacc

SEQ ID NO: 70093 - RNA, 19 nt, Artificial Sequence
  Synthetic Oligonucleotide; PD-1 target exon 3; Set B
ggggcugggaugacguuac

SEQ ID NO: 70094 - RNA, 23 nt, Artificial Sequence
  Synthetic Oligonucleotide; PD-1 target exon 3; Set C
gaggggcugggaugacguuaccu

SEQ ID NO: 70095 - RNA, 21 nt, Artificial Sequence
  Synthetic Oligonucleotide; PD-1 target exon 3; Set B
aggggcugggaugacguuacc

SEQ ID NO: 70096 - RNA, 20 nt, Artificial Sequence
  Synthetic Oligonucleotide; PD-1 target exon 3; Set B
aggggcugggaugacguuac

SEQ ID NO: 70097 - RNA, 22 nt, Artificial Sequence
  Synthetic Oligonucleotide; PD-1 target exon 3; Set C
gaggggcugggaugacguuacc

SEQ ID NO: 70098 - RNA, 38 nt, Artificial Sequence
  Synthetic Oligonucleotide; PD-1 target exon 3; Set C
gggcagggcaggccgaggggcugggaugacguuaccuc

SEQ ID NO: 70099 - RNA, 39 nt, Artificial Sequence
  Synthetic Oligonucleotide; PD-1 target exon 3; Set C
agggcagggcaggccgaggggcugggaugacguuaccuc

SEQ ID NO: 70100 - RNA, 40 nt, Artificial Sequence
  Synthetic Oligonucleotide; PD-1 target exon 3; Set C
uagggcagggcaggccgaggggcugggaugacguuaccuc

SEQ ID NO: 70101 - RNA, 15 nt, Artificial Sequence
  Synthetic Oligonucleotide; PD-1 target exon 3; Set B
caggccgaggggcug

SEQ ID NO: 70102 - RNA, 40 nt, Artificial Sequence
  Synthetic Oligonucleotide; PD-1 target exon 3; Set C
cagcaggguuagggcagggcaggccgaggggcugggauga

SEQ ID NO: 70103 - RNA, 39 nt, Artificial Sequence
  Synthetic Oligonucleotide; PD-1 target exon 3; Set C
cagcaggguuagggcagggcaggccgaggggcugggaug

SEQ ID NO: 70104 - RNA, 38 nt, Artificial Sequence
  Synthetic Oligonucleotide; PD-1 target exon 3; Set C
cagcaggguuagggcagggcaggccgaggggcugggau

SEQ ID NO: 70105 - RNA, 37 nt, Artificial Sequence
  Synthetic Oligonucleotide; PD-1 target exon 3; Set C
cagcaggguuagggcagggcaggccgaggggcuggga

SEQ ID NO: 70106 - RNA, 36 nt, Artificial Sequence
  Synthetic Oligonucleotide; PD-1 target exon 3; Set C
cagcaggguuagggcagggcaggccgaggggcuggg

SEQ ID NO: 70107 - RNA, 40 nt, Artificial Sequence
  Synthetic Oligonucleotide; PD-1 target exon 3; Set C
cgccagcaggguuagggcagggcaggccgaggggcuggga

SEQ ID NO: 70108 - RNA, 39 nt, Artificial Sequence
  Synthetic Oligonucleotide; PD-1 target exon 3; Set C
cgccagcaggguuagggcagggcaggccgaggggcuggg

SEQ ID NO: 70109 - RNA, 38 nt, Artificial Sequence
  Synthetic Oligonucleotide; PD-1 target exon 3; Set C
cgccagcaggguuagggcagggcaggccgaggggcugg

SEQ ID NO: 70110 - RNA, 37 nt, Artificial Sequence
  Synthetic Oligonucleotide; PD-1 target exon 3; Set C
cgccagcaggguuagggcagggcaggccgaggggcug

SEQ ID NO: 70111 - RNA, 36 nt, Artificial Sequence
  Synthetic Oligonucleotide; PD-1 target exon 3; Set C
cgccagcaggguuagggcagggcaggccgaggggcu

SEQ ID NO: 70112 - RNA, 32 nt, Artificial Sequence
  Synthetic Oligonucleotide; PD-1 target exon 3; Set C
ccagcaggguuagggcagggcaggccgagggg

SEQ ID NO: 70113 - RNA, 35 nt, Artificial Sequence
  Synthetic Oligonucleotide; PD-1 target exon 3; Set C
cgccagcaggguuagggcagggcaggccgaggggc

SEQ ID NO: 70114 - RNA, 31 nt, Artificial Sequence
  Synthetic Oligonucleotide; PD-1 target exon 3; Set C
ccagcaggguuagggcagggcaggccgaggg

SEQ ID NO: 70115 - RNA, 33 nt, Artificial Sequence
  Synthetic Oligonucleotide; PD-1 target exon 3; Set C
gccagcaggguuagggcagggcaggccgagggg

SEQ ID NO: 70116 - RNA, 30 nt, Artificial Sequence
  Synthetic Oligonucleotide; PD-1 target exon 3; Set C
ccagcaggguuagggcagggcaggccgagg

SEQ ID NO: 70117 - RNA, 32 nt, Artificial Sequence
  Synthetic Oligonucleotide; PD-1 target exon 3; Set C
gccagcaggguuagggcagggcaggccgaggg

SEQ ID NO: 70118 - RNA, 29 nt, Artificial Sequence
  Synthetic Oligonucleotide; PD-1 target exon 3; Set C
ccagcaggguuagggcagggcaggccgag

SEQ ID NO: 70119 - RNA, 31 nt, Artificial Sequence
  Synthetic Oligonucleotide; PD-1 target exon 3; Set C
gccagcaggguuagggcagggcaggccgagg

SEQ ID NO: 70120 - RNA, 30 nt, Artificial Sequence
  Synthetic Oligonucleotide; PD-1 target exon 3; Set C
gccagcaggguuagggcagggcaggccgag

SEQ ID NO: 70121 - RNA, 23 nt, Artificial Sequence
  Synthetic Oligonucleotide; PD-1 target exon 3; Set C
ccagcaggguuagggcagggcag

SEQ ID NO: 70122 - RNA, 24 nt, Artificial Sequence
  Synthetic Oligonucleotide; PD-1 target exon 3; Set C
gccagcaggguuagggcagggcag

SEQ ID NO: 70123 - RNA, 16 nt, Artificial Sequence
  Synthetic Oligonucleotide; PD-1 target exon 3; Set B
cagcaggguuagggca

SEQ ID NO: 70124 - RNA, 15 nt, Artificial Sequence
  Synthetic Oligonucleotide; PD-1 target exon 3; Set C
cagcaggguuagggc

SEQ ID NO: 70125 - RNA, 19 nt, Artificial Sequence
  Synthetic Oligonucleotide; PD-1 target exon 3; Set C
cgccagcaggguuagggca

SEQ ID NO: 70126 - RNA, 18 nt, Artificial Sequence
  Synthetic Oligonucleotide; PD-1 target exon 3; Set B
cgccagcaggguuagggc

SEQ ID NO: 70127 - RNA, 23 nt, Artificial Sequence
  Synthetic Oligonucleotide; PD-1 target exon 3; Set C
gguuaggacggggucagggugga

SEQ ID NO: 70128 - RNA, 30 nt, Artificial Sequence
  Synthetic Oligonucleotide; PD-1 target exon 3; Set C
cagggguuaggacggggucaggguggaggg

SEQ ID NO: 70129 - RNA, 24 nt, Artificial Sequence
  Synthetic Oligonucleotide; PD-1 target exon 3; Set C
ggguuaggacggggucagggugga

SEQ ID NO: 70130 - RNA, 22 nt, Artificial Sequence
  Synthetic Oligonucleotide; PD-1 target exon 3; Set C
gguuaggacggggucagggugg

SEQ ID NO: 70131 - RNA, 29 nt, Artificial Sequence
  Synthetic Oligonucleotide; PD-1 target exon 3; Set C
cagggguuaggacggggucaggguggagg

SEQ ID NO: 70132 - RNA, 21 nt, Artificial Sequence
  Synthetic Oligonucleotide; PD-1 target exon 3; Set C
gguuaggacggggucagggug

SEQ ID NO: 70133 - RNA, 23 nt, Artificial Sequence
  Synthetic Oligonucleotide; PD-1 target exon 3; Set C
ggguuaggacggggucagggugg

SEQ ID NO: 70134 - RNA, 22 nt, Artificial Sequence
  Synthetic Oligonucleotide; PD-1 target exon 3; Set C
ggguuaggacggggucagggug

SEQ ID NO: 70135 - RNA, 30 nt, Artificial Sequence
  Synthetic Oligonucleotide; PD-1 target exon 3; Set C
ggucagggguuaggacggggucagggugga

SEQ ID NO: 70136 - RNA, 31 nt, Artificial Sequence
  Synthetic Oligonucleotide; PD-1 target exon 3; Set C
aggucagggguuaggacggggucagggugga

SEQ ID NO: 70137 - RNA, 29 nt, Artificial Sequence
  Synthetic Oligonucleotide; PD-1 target exon 3; Set C
ggucagggguuaggacggggucagggugg

SEQ ID NO: 70138 - RNA, 32 nt, Artificial Sequence
  Synthetic Oligonucleotide; PD-1 target exon 3; Set C
aaggucagggguuaggacggggucagggugga

SEQ ID NO: 70139 - RNA, 28 nt, Artificial Sequence
  Synthetic Oligonucleotide; PD-1 target exon 3; Set C
ggucagggguuaggacggggucagggug

SEQ ID NO: 70140 - RNA, 29 nt, Artificial Sequence
  Synthetic Oligonucleotide; PD-1 target exon 3; Set C
aggucagggguuaggacggggucagggug

SEQ ID NO: 70141 - RNA, 27 nt, Artificial Sequence
  Synthetic Oligonucleotide; PD-1 target exon 3; Set C
aaaggucagggguuaggacggggucag

SEQ ID NO: 70142 - RNA, 28 nt, Artificial Sequence
  Synthetic Oligonucleotide; PD-1 target exon 3; Set C
caaaggucagggguuaggacggggucag

SEQ ID NO: 70143 - RNA, 17 nt, Artificial Sequence
  Synthetic Oligonucleotide; PD-1 target exon 3; Set C
aaaggucagggguuagg

SEQ ID NO: 70144 - RNA, 18 nt, Artificial Sequence
  Synthetic Oligonucleotide; PD-1 target exon 3; Set C
caaaggucagggguuagg

SEQ ID NO: 70145 - RNA, 40 nt, Artificial Sequence
  Synthetic Oligonucleotide; PD-1 target exon 3; Set C
gugggcacuucugcccuucucucuggaagggcacaaaggu

SEQ ID NO: 70146 - RNA, 39 nt, Artificial Sequence
  Synthetic Oligonucleotide; PD-1 target exon 3; Set C
gugggcacuucugcccuucucucuggaagggcacaaagg

SEQ ID NO: 70147 - RNA, 40 nt, Artificial Sequence
  Synthetic Oligonucleotide; PD-1 target exon 3; Set C
ugugggcacuucugcccuucucucuggaagggcacaaagg

SEQ ID NO: 70148 - RNA, 39 nt, Artificial Sequence
  Synthetic Oligonucleotide; PD-1 target exon 3; Set C
ugugggcacuucugcccuucucucuggaagggcacaaag

SEQ ID NO: 70149 - RNA, 18 nt, Artificial Sequence
  Synthetic Oligonucleotide; PD-1 target exon 3; Set C
acuucugcccuucucucu

SEQ ID NO: 70150 - RNA, 17 nt, Artificial Sequence
  Synthetic Oligonucleotide; PD-1 target exon 3; Set C
acuucugcccuucucuc

SEQ ID NO: 70151 - RNA, 16 nt, Artificial Sequence
  Synthetic Oligonucleotide; PD-1 target exon 3; Set C
acuucugcccuucucu

SEQ ID NO: 70152 - RNA, 21 nt, Artificial Sequence
  Synthetic Oligonucleotide; PD-1 target exon 3; Set A
ugggcacuucugcccuucucu

SEQ ID NO: 70153 - RNA, 26 nt, Artificial Sequence
  Synthetic Oligonucleotide; PD-1 target exon 3; Set C
cugugggcacuucugcccuucucucu

SEQ ID NO: 70154 - RNA, 25 nt, Artificial Sequence
  Synthetic Oligonucleotide; PD-1 target exon 3; Set C
cugugggcacuucugcccuucucuc

SEQ ID NO: 70155 - RNA, 24 nt, Artificial Sequence
  Synthetic Oligonucleotide; PD-1 target exon 3; Set C
cugugggcacuucugcccuucucu

SEQ ID NO: 70156 - RNA, 40 nt, Artificial Sequence
  Synthetic Oligonucleotide; PD-1 target exon 3; Set C
gggcuggggugggcugugggcacuucugcccuucucucug

SEQ ID NO: 70157 - RNA, 39 nt, Artificial Sequence
  Synthetic Oligonucleotide; PD-1 target exon 3; Set C
gggcuggggugggcugugggcacuucugcccuucucucu

SEQ ID NO: 70158 - RNA, 38 nt, Artificial Sequence
  Synthetic Oligonucleotide; PD-1 target exon 3; Set C
gggcuggggugggcugugggcacuucugcccuucucuc

SEQ ID NO: 70159 - RNA, 40 nt, Artificial Sequence
  Synthetic Oligonucleotide; PD-1 target exon 3; Set C
ggggcuggggugggcugugggcacuucugcccuucucucu

SEQ ID NO: 70160 - RNA, 37 nt, Artificial Sequence
  Synthetic Oligonucleotide; PD-1 target exon 3; Set C
gggcuggggugggcugugggcacuucugcccuucucu

SEQ ID NO: 70161 - RNA, 39 nt, Artificial Sequence
  Synthetic Oligonucleotide; PD-1 target exon 3; Set C
ggggcuggggugggcugugggcacuucugcccuucucuc

SEQ ID NO: 70162 - RNA, 38 nt, Artificial Sequence
  Synthetic Oligonucleotide; PD-1 target exon 3; Set C
ggggcuggggugggcugugggcacuucugcccuucucu

SEQ ID NO: 70163 - RNA, 30 nt, Artificial Sequence
  Synthetic Oligonucleotide; PD-1 target exon 3; Set C
ggugaggggcuggggugggcugugggcacu

SEQ ID NO: 70164 - RNA, 31 nt, Artificial Sequence
  Synthetic Oligonucleotide; PD-1 target exon 3; Set C
gggugaggggcuggggugggcugugggcacu

SEQ ID NO: 70165 - RNA, 21 nt, Artificial Sequence
  Synthetic Oligonucleotide; PD-1 target exon 3; Set C
gaggggcuggggugggcugug

SEQ ID NO: 70166 - RNA, 22 nt, Artificial Sequence
  Synthetic Oligonucleotide; PD-1 target exon 3; Set C
ugaggggcuggggugggcugug

SEQ ID NO: 70167 - RNA, 23 nt, Artificial Sequence
  Synthetic Oligonucleotide; PD-1 target exon 3; Set C
gugaggggcuggggugggcugug

SEQ ID NO: 70168 - RNA, 25 nt, Artificial Sequence
  Synthetic Oligonucleotide; PD-1 target exon 3; Set C
ggugaggggcuggggugggcugugg

SEQ ID NO: 70169 - RNA, 26 nt, Artificial Sequence
  Synthetic Oligonucleotide; PD-1 target exon 3; Set C
gggugaggggcuggggugggcugugg

SEQ ID NO: 70170 - RNA, 24 nt, Artificial Sequence
  Synthetic Oligonucleotide; PD-1 target exon 3; Set C
ugggugaggggcuggggugggcug

SEQ ID NO: 70171 - RNA, 15 nt, Artificial Sequence
  Synthetic Oligonucleotide; PD-1 target exon 3; Set A
gcuggccugggugag

SEQ ID NO: 70172 - RNA, 16 nt, Artificial Sequence
  Synthetic Oligonucleotide; PD-1 target exon 3; Set A
ggcuggccugggugag

SEQ ID NO: 70173 - RNA, 15 nt, Artificial Sequence
  Synthetic Oligonucleotide; PD-1 target exon 3; Set A
ggcuggccuggguga

SEQ ID NO: 70174 - RNA, 23 nt, Artificial Sequence
  Synthetic Oligonucleotide; PD-1 target exon 3; Set C
acuggccggcuggccugggugag

SEQ ID NO: 70175 - RNA, 22 nt, Artificial Sequence
  Synthetic Oligonucleotide; PD-1 target exon 3; Set C
acuggccggcuggccuggguga

SEQ ID NO: 70176 - RNA, 24 nt, Artificial Sequence
  Synthetic Oligonucleotide; PD-1 target exon 3; Set C
aacuggccggcuggccugggugag

SEQ ID NO: 70177 - RNA, 23 nt, Artificial Sequence
  Synthetic Oligonucleotide; PD-1 target exon 3; Set C
aacuggccggcuggccuggguga

SEQ ID NO: 70178 - RNA, 21 nt, Artificial Sequence
  Synthetic Oligonucleotide; PD-1 target exon 3; Set C
acuggccggcuggccugggug

SEQ ID NO: 70179 - RNA, 20 nt, Artificial Sequence
  Synthetic Oligonucleotide; PD-1 target exon 3; Set C
acuggccggcuggccugggu

SEQ ID NO: 70180 - RNA, 22 nt, Artificial Sequence
  Synthetic Oligonucleotide; PD-1 target exon 3; Set C
aacuggccggcuggccugggug

SEQ ID NO: 70181 - RNA, 21 nt, Artificial Sequence
  Synthetic Oligonucleotide; PD-1 target exon 3; Set C
aacuggccggcuggccugggu

SEQ ID NO: 70182 - RNA, 19 nt, Artificial Sequence
  Synthetic Oligonucleotide; PD-1 target exon 3; Set C
acuggccggcuggccuggg

SEQ ID NO: 70183 - RNA, 20 nt, Artificial Sequence
  Synthetic Oligonucleotide; PD-1 target exon 3; Set C
aacuggccggcuggccuggg

SEQ ID NO: 70184 - RNA, 34 nt, Artificial Sequence
  Synthetic Oligonucleotide; PD-1 target exon 3; Set C
gacaccaaccaccaggguuuggaacuggccggcu

SEQ ID NO: 70185 - RNA, 33 nt, Artificial Sequence
  Synthetic Oligonucleotide; PD-1 target exon 3; Set C
gacaccaaccaccaggguuuggaacuggccggc

SEQ ID NO: 70186 - RNA, 25 nt, Artificial Sequence
  Synthetic Oligonucleotide; PD-1 target exon 3; Set C
acaccaaccaccaggguuuggaacu

SEQ ID NO: 70187 - RNA, 24 nt, Artificial Sequence
  Synthetic Oligonucleotide; PD-1 target exon 3; Set C
acaccaaccaccaggguuuggaac

SEQ ID NO: 70188 - RNA, 20 nt, Artificial Sequence
  Synthetic Oligonucleotide; PD-1 target exon 3; Set A
cgacaccaaccaccaggguu

SEQ ID NO: 70189 - RNA, 19 nt, Artificial Sequence
  Synthetic Oligonucleotide; PD-1 target exon 3; Set A
cgacaccaaccaccagggu

SEQ ID NO: 70190 - RNA, 29 nt, Artificial Sequence
  Synthetic Oligonucleotide; PD-1 target exon 3; Set C
agacuagcagcaccaggcugcccagcagg

SEQ ID NO: 70191 - RNA, 36 nt, Artificial Sequence
  Synthetic Oligonucleotide; PD-1 target exon 3; Set C
aggacccagacuagcagcaccaggcugcccagcagg

SEQ ID NO: 70192 - RNA, 34 nt, Artificial Sequence
  Synthetic Oligonucleotide; PD-1 target exon 3; Set C
ugacggccaggacccagacuagcagcaccaggcu

SEQ ID NO: 70193 - RNA, 31 nt, Artificial Sequence
  Synthetic Oligonucleotide; PD-1 target exon 3; Set C
gacggccaggacccagacuagcagcaccagg

SEQ ID NO: 70194 - RNA, 35 nt, Artificial Sequence
  Synthetic Oligonucleotide; PD-1 target exon 3; Set C
augacggccaggacccagacuagcagcaccaggcu

SEQ ID NO: 70195 - RNA, 33 nt, Artificial Sequence
  Synthetic Oligonucleotide; PD-1 target exon 3; Set C
ugacggccaggacccagacuagcagcaccaggc

SEQ ID NO: 70196 - RNA, 32 nt, Artificial Sequence
  Synthetic Oligonucleotide; PD-1 target exon 3; Set C
ugacggccaggacccagacuagcagcaccagg

SEQ ID NO: 70197 - RNA, 36 nt, Artificial Sequence
  Synthetic Oligonucleotide; PD-1 target exon 3; Set C
gaugacggccaggacccagacuagcagcaccaggcu

SEQ ID NO: 70198 - RNA, 34 nt, Artificial Sequence
  Synthetic Oligonucleotide; PD-1 target exon 3; Set C
augacggccaggacccagacuagcagcaccaggc

SEQ ID NO: 70199 - RNA, 33 nt, Artificial Sequence
  Synthetic Oligonucleotide; PD-1 target exon 3; Set C
augacggccaggacccagacuagcagcaccagg

SEQ ID NO: 70200 - RNA, 37 nt, Artificial Sequence
  Synthetic Oligonucleotide; PD-1 target exon 3; Set C
agaugacggccaggacccagacuagcagcaccaggcu

SEQ ID NO: 70201 - RNA, 35 nt, Artificial Sequence
  Synthetic Oligonucleotide; PD-1 target exon 3; Set C
gaugacggccaggacccagacuagcagcaccaggc

SEQ ID NO: 70202 - RNA, 34 nt, Artificial Sequence
  Synthetic Oligonucleotide; PD-1 target exon 3; Set C
gaugacggccaggacccagacuagcagcaccagg

SEQ ID NO: 70203 - RNA, 38 nt, Artificial Sequence
  Synthetic Oligonucleotide; PD-1 target exon 3; Set C
cagaugacggccaggacccagacuagcagcaccaggcu

SEQ ID NO: 70204 - RNA, 36 nt, Artificial Sequence
  Synthetic Oligonucleotide; PD-1 target exon 3; Set C
agaugacggccaggacccagacuagcagcaccaggc

SEQ ID NO: 70205 - RNA, 39 nt, Artificial Sequence
  Synthetic Oligonucleotide; PD-1 target exon 3; Set C
gcagaugacggccaggacccagacuagcagcaccaggcu

SEQ ID NO: 70206 - RNA, 37 nt, Artificial Sequence
  Synthetic Oligonucleotide; PD-1 target exon 3; Set C
cagaugacggccaggacccagacuagcagcaccaggc

SEQ ID NO: 70207 - RNA, 36 nt, Artificial Sequence
  Synthetic Oligonucleotide; PD-1 target exon 3; Set C
cagaugacggccaggacccagacuagcagcaccagg

SEQ ID NO: 70208 - RNA, 40 nt, Artificial Sequence
  Synthetic Oligonucleotide; PD-1 target exon 3; Set C
agcagaugacggccaggacccagacuagcagcaccaggcu

SEQ ID NO: 70209 - RNA, 38 nt, Artificial Sequence
  Synthetic Oligonucleotide; PD-1 target exon 3; Set C
gcagaugacggccaggacccagacuagcagcaccaggc

SEQ ID NO: 70210 - RNA, 37 nt, Artificial Sequence
  Synthetic Oligonucleotide; PD-1 target exon 3; Set C
gcagaugacggccaggacccagacuagcagcaccagg

SEQ ID NO: 70211 - RNA, 39 nt, Artificial Sequence
  Synthetic Oligonucleotide; PD-1 target exon 3; Set C
agcagaugacggccaggacccagacuagcagcaccaggc

SEQ ID NO: 70212 - RNA, 40 nt, Artificial Sequence
  Synthetic Oligonucleotide; PD-1 target exon 3; Set C
gagcagaugacggccaggacccagacuagcagcaccaggc

SEQ ID NO: 70213 - RNA, 19 nt, Artificial Sequence
  Synthetic Oligonucleotide; PD-1 target exon 3; Set C
acggccaggacccagacua

SEQ ID NO: 70214 - RNA, 39 nt, Artificial Sequence
  Synthetic Oligonucleotide; PD-1 target exon 3; Set C
ggagcagaugacggccaggacccagacuagcagcaccag

SEQ ID NO: 70215 - RNA, 23 nt, Artificial Sequence
  Synthetic Oligonucleotide; PD-1 target exon 3; Set C
ugacggccaggacccagacuagc

SEQ ID NO: 70216 - RNA, 20 nt, Artificial Sequence
  Synthetic Oligonucleotide; PD-1 target exon 3; Set C
gacggccaggacccagacua

SEQ ID NO: 70217 - RNA, 18 nt, Artificial Sequence
  Synthetic Oligonucleotide; PD-1 target exon 3; Set A
acggccaggacccagacu

SEQ ID NO: 70218 - RNA, 40 nt, Artificial Sequence
  Synthetic Oligonucleotide; PD-1 target exon 3; Set C
gggagcagaugacggccaggacccagacuagcagcaccag

SEQ ID NO: 70219 - RNA, 24 nt, Artificial Sequence
  Synthetic Oligonucleotide; PD-1 target exon 3; Set C
augacggccaggacccagacuagc

SEQ ID NO: 70220 - RNA, 26 nt, Artificial Sequence
  Synthetic Oligonucleotide; PD-1 target exon 3; Set C
gaugacggccaggacccagacuagca

SEQ ID NO: 70221 - RNA, 19 nt, Artificial Sequence
  Synthetic Oligonucleotide; PD-1 target exon 3; Set C
gacggccaggacccagacu

SEQ ID NO: 70222 - RNA, 25 nt, Artificial Sequence
  Synthetic Oligonucleotide; PD-1 target exon 3; Set C
gaugacggccaggacccagacuagc

SEQ ID NO: 70223 - RNA, 27 nt, Artificial Sequence
  Synthetic Oligonucleotide; PD-1 target exon 3; Set C
agaugacggccaggacccagacuagca

SEQ ID NO: 70224 - RNA, 18 nt, Artificial Sequence
  Synthetic Oligonucleotide; PD-1 target exon 3; Set A
gacggccaggacccagac

SEQ ID NO: 70225 - RNA, 26 nt, Artificial Sequence
  Synthetic Oligonucleotide; PD-1 target exon 3; Set C
agaugacggccaggacccagacuagc

SEQ ID NO: 70226 - RNA, 15 nt, Artificial Sequence
  Synthetic Oligonucleotide; PD-1 target exon 3; Set A
acggccaggacccag

SEQ ID NO: 70227 - RNA, 19 nt, Artificial Sequence
  Synthetic Oligonucleotide; PD-1 target exon 3; Set C
ugacggccaggacccagac

SEQ ID NO: 70228 - RNA, 27 nt, Artificial Sequence
  Synthetic Oligonucleotide; PD-1 target exon 3; Set C
cagaugacggccaggacccagacuagc

SEQ ID NO: 70229 - RNA, 29 nt, Artificial Sequence
  Synthetic Oligonucleotide; PD-1 target exon 3; Set C
gcagaugacggccaggacccagacuagca

SEQ ID NO: 70230 - RNA, 16 nt, Artificial Sequence
  Synthetic Oligonucleotide; PD-1 target exon 3; Set A
gacggccaggacccag

SEQ ID NO: 70231 - RNA, 28 nt, Artificial Sequence
  Synthetic Oligonucleotide; PD-1 target exon 3; Set C
gcagaugacggccaggacccagacuagc

SEQ ID NO: 70232 - RNA, 30 nt, Artificial Sequence
  Synthetic Oligonucleotide; PD-1 target exon 3; Set C
agcagaugacggccaggacccagacuagca

SEQ ID NO: 70233 - RNA, 29 nt, Artificial Sequence
  Synthetic Oligonucleotide; PD-1 target exon 3; Set C
agcagaugacggccaggacccagacuagc

SEQ ID NO: 70234 - RNA, 31 nt, Artificial Sequence
  Synthetic Oligonucleotide; PD-1 target exon 3; Set C
gagcagaugacggccaggacccagacuagca

SEQ ID NO: 70235 - RNA, 30 nt, Artificial Sequence
  Synthetic Oligonucleotide; PD-1 target exon 3; Set C
gagcagaugacggccaggacccagacuagc

SEQ ID NO: 70236 - RNA, 32 nt, Artificial Sequence
  Synthetic Oligonucleotide; PD-1 target exon 3; Set C
ggagcagaugacggccaggacccagacuagca

SEQ ID NO: 70237 - RNA, 31 nt, Artificial Sequence
  Synthetic Oligonucleotide; PD-1 target exon 3; Set C
ggagcagaugacggccaggacccagacuagc

SEQ ID NO: 70238 - RNA, 33 nt, Artificial Sequence
  Synthetic Oligonucleotide; PD-1 target exon 3; Set C
gggagcagaugacggccaggacccagacuagca

SEQ ID NO: 70239 - RNA, 32 nt, Artificial Sequence
  Synthetic Oligonucleotide; PD-1 target exon 3; Set C
gggagcagaugacggccaggacccagacuagc

SEQ ID NO: 70240 - RNA, 15 nt, Artificial Sequence
  Synthetic Oligonucleotide; PD-1 target exon 3; Set C
ggagcagaugacggc

SEQ ID NO: 70241 - RNA, 16 nt, Artificial Sequence
  Synthetic Oligonucleotide; PD-1 target exon 3; Set B
gggagcagaugacggc

SEQ ID NO: 70242 - RNA, 15 nt, Artificial Sequence
  Synthetic Oligonucleotide; PD-1 target exon 3; Set C
cgggagcagaugacg

SEQ ID NO: 70243 - RNA, 18 nt, Artificial Sequence
  Synthetic Oligonucleotide; PD-1 target exon 3; Set B
gcccgggagcagaugacg

SEQ ID NO: 70244 - RNA, 19 nt, Artificial Sequence
  Synthetic Oligonucleotide; PD-1 target exon 3; Set C
ggcccgggagcagaugacg

SEQ ID NO: 70245 - RNA, 17 nt, Artificial Sequence
  Synthetic Oligonucleotide; PD-1 target exon 3; Set B
gcccgggagcagaugac

SEQ ID NO: 70246 - RNA, 16 nt, Artificial Sequence
  Synthetic Oligonucleotide; PD-1 target exon 3; Set B
gcccgggagcagauga

SEQ ID NO: 70247 - RNA, 18 nt, Artificial Sequence
  Synthetic Oligonucleotide; PD-1 target exon 3; Set B
ggcccgggagcagaugac

SEQ ID NO: 70248 - RNA, 17 nt, Artificial Sequence
  Synthetic Oligonucleotide; PD-1 target exon 3; Set B
ggcccgggagcagauga

SEQ ID NO: 70249 - RNA, 15 nt, Artificial Sequence
  Synthetic Oligonucleotide; PD-1 target exon 3; Set C
gcccgggagcagaug

SEQ ID NO: 70250 - RNA, 16 nt, Artificial Sequence
  Synthetic Oligonucleotide; PD-1 target exon 3; Set B
ggcccgggagcagaug

SEQ ID NO: 70251 - RNA, 19 nt, Artificial Sequence
  Synthetic Oligonucleotide; PD-1 target exon 3; Set C
gcggcccgggagcagauga

SEQ ID NO: 70252 - RNA, 15 nt, Artificial Sequence
  Synthetic Oligonucleotide; PD-1 target exon 3; Set B
ggcccgggagcagau

SEQ ID NO: 70253 - RNA, 20 nt, Artificial Sequence
  Synthetic Oligonucleotide; PD-1 target exon 3; Set C
ugcggcccgggagcagauga

SEQ ID NO: 70254 - RNA, 21 nt, Artificial Sequence
  Synthetic Oligonucleotide; PD-1 target exon 3; Set C
gugcggcccgggagcagauga

SEQ ID NO: 70255 - RNA, 19 nt, Artificial Sequence
  Synthetic Oligonucleotide; PD-1 target exon 3; Set C
ugcggcccgggagcagaug

SEQ ID NO: 70256 - RNA, 20 nt, Artificial Sequence
  Synthetic Oligonucleotide; PD-1 target exon 3; Set C
gugcggcccgggagcagaug

SEQ ID NO: 70257 - RNA, 26 nt, Artificial Sequence
  Synthetic Oligonucleotide; PD-1 target exon 3; Set C
cucgugcggcccgggagcagaugacg

SEQ ID NO: 70258 - RNA, 19 nt, Artificial Sequence
  Synthetic Oligonucleotide; PD-1 target exon 3; Set C
gugcggcccgggagcagau

SEQ ID NO: 70259 - RNA, 25 nt, Artificial Sequence
  Synthetic Oligonucleotide; PD-1 target exon 3; Set C
cucgugcggcccgggagcagaugac

SEQ ID NO: 70260 - RNA, 24 nt, Artificial Sequence
  Synthetic Oligonucleotide; PD-1 target exon 3; Set C
cucgugcggcccgggagcagauga

SEQ ID NO: 70261 - RNA, 18 nt, Artificial Sequence
  Synthetic Oligonucleotide; PD-1 target exon 3; Set C
gugcggcccgggagcaga

SEQ ID NO: 70262 - RNA, 23 nt, Artificial Sequence
  Synthetic Oligonucleotide; PD-1 target exon 3; Set C
cucgugcggcccgggagcagaug

SEQ ID NO: 70263 - RNA, 31 nt, Artificial Sequence
  Synthetic Oligonucleotide; PD-1 target exon 3; Set C
uuaccucgugcggcccgggagcagaugacgg

SEQ ID NO: 70264 - RNA, 22 nt, Artificial Sequence
  Synthetic Oligonucleotide; PD-1 target exon 3; Set C
cucgugcggcccgggagcagau

SEQ ID NO: 70265 - RNA, 32 nt, Artificial Sequence
  Synthetic Oligonucleotide; PD-1 target exon 3; Set C
guuaccucgugcggcccgggagcagaugacgg

SEQ ID NO: 70266 - RNA, 21 nt, Artificial Sequence
  Synthetic Oligonucleotide; PD-1 target exon 3; Set C
cucgugcggcccgggagcaga

SEQ ID NO: 70267 - RNA, 33 nt, Artificial Sequence
  Synthetic Oligonucleotide; PD-1 target exon 3; Set C
cguuaccucgugcggcccgggagcagaugacgg

SEQ ID NO: 70268 - RNA, 20 nt, Artificial Sequence
  Synthetic Oligonucleotide; PD-1 target exon 3; Set C
cucgugcggcccgggagcag

SEQ ID NO: 70269 - RNA, 34 nt, Artificial Sequence
  Synthetic Oligonucleotide; PD-1 target exon 3; Set C
acguuaccucgugcggcccgggagcagaugacgg

SEQ ID NO: 70270 - RNA, 19 nt, Artificial Sequence
  Synthetic Oligonucleotide; PD-1 target exon 3; Set C
cucgugcggcccgggagca

SEQ ID NO: 70271 - RNA, 35 nt, Artificial Sequence
  Synthetic Oligonucleotide; PD-1 target exon 3; Set C
gacguuaccucgugcggcccgggagcagaugacgg

SEQ ID NO: 70272 - RNA, 36 nt, Artificial Sequence
  Synthetic Oligonucleotide; PD-1 target exon 3; Set C
ugacguuaccucgugcggcccgggagcagaugacgg

SEQ ID NO: 70273 - RNA, 37 nt, Artificial Sequence
  Synthetic Oligonucleotide; PD-1 target exon 3; Set C
augacguuaccucgugcggcccgggagcagaugacgg

SEQ ID NO: 70274 - RNA, 38 nt, Artificial Sequence
  Synthetic Oligonucleotide; PD-1 target exon 3; Set C
gaugacguuaccucgugcggcccgggagcagaugacgg

SEQ ID NO: 70275 - RNA, 39 nt, Artificial Sequence
  Synthetic Oligonucleotide; PD-1 target exon 3; Set C
ggaugacguuaccucgugcggcccgggagcagaugacgg

SEQ ID NO: 70276 - RNA, 40 nt, Artificial Sequence
  Synthetic Oligonucleotide; PD-1 target exon 3; Set C
gggaugacguuaccucgugcggcccgggagcagaugacgg

SEQ ID NO: 70277 - RNA, 18 nt, Artificial Sequence
  Synthetic Oligonucleotide; PD-1 target exon 3; Set B
gacguuaccucgugcggc

SEQ ID NO: 70278 - RNA, 19 nt, Artificial Sequence
  Synthetic Oligonucleotide; PD-1 target exon 3; Set B
ugacguuaccucgugcggc

SEQ ID NO: 70279 - RNA, 21 nt, Artificial Sequence
  Synthetic Oligonucleotide; PD-1 target exon 3; Set C
augacguuaccucgugcggcc

SEQ ID NO: 70280 - RNA, 20 nt, Artificial Sequence
  Synthetic Oligonucleotide; PD-1 target exon 3; Set B
augacguuaccucgugcggc

SEQ ID NO: 70281 - RNA, 22 nt, Artificial Sequence
  Synthetic Oligonucleotide; PD-1 target exon 3; Set C
gaugacguuaccucgugcggcc

SEQ ID NO: 70282 - RNA, 16 nt, Artificial Sequence
  Synthetic Oligonucleotide; PD-1 target exon 3; Set C
gacguuaccucgugcg

SEQ ID NO: 70283 - RNA, 21 nt, Artificial Sequence
  Synthetic Oligonucleotide; PD-1 target exon 3; Set B
gaugacguuaccucgugcggc

SEQ ID NO: 70284 - RNA, 23 nt, Artificial Sequence
  Synthetic Oligonucleotide; PD-1 target exon 3; Set C
ggaugacguuaccucgugcggcc

SEQ ID NO: 70285 - RNA, 17 nt, Artificial Sequence
  Synthetic Oligonucleotide; PD-1 target exon 3; Set C
ugacguuaccucgugcg

SEQ ID NO: 70286 - RNA, 22 nt, Artificial Sequence
  Synthetic Oligonucleotide; PD-1 target exon 3; Set C
ggaugacguuaccucgugcggc

SEQ ID NO: 70287 - RNA, 16 nt, Artificial Sequence
  Synthetic Oligonucleotide; PD-1 target exon 3; Set C
ugacguuaccucgugc

SEQ ID NO: 70288 - RNA, 18 nt, Artificial Sequence
  Synthetic Oligonucleotide; PD-1 target exon 3; Set C
augacguuaccucgugcg

SEQ ID NO: 70289 - RNA, 23 nt, Artificial Sequence
  Synthetic Oligonucleotide; PD-1 target exon 3; Set C
gggaugacguuaccucgugcggc

SEQ ID NO: 70290 - RNA, 15 nt, Artificial Sequence
  Synthetic Oligonucleotide; PD-1 target exon 3; Set C
ugacguuaccucgug

SEQ ID NO: 70291 - RNA, 19 nt, Artificial Sequence
  Synthetic Oligonucleotide; PD-1 target exon 3; Set B
gaugacguuaccucgugcg

SEQ ID NO: 70292 - RNA, 17 nt, Artificial Sequence
  Synthetic Oligonucleotide; PD-1 target exon 3; Set C
augacguuaccucgugc

SEQ ID NO: 70293 - RNA, 24 nt, Artificial Sequence
  Synthetic Oligonucleotide; PD-1 target exon 3; Set C
ugggaugacguuaccucgugcggc

SEQ ID NO: 70294 - RNA, 16 nt, Artificial Sequence
  Synthetic Oligonucleotide; PD-1 target exon 3; Set C
augacguuaccucgug

SEQ ID NO: 70295 - RNA, 18 nt, Artificial Sequence
  Synthetic Oligonucleotide; PD-1 target exon 3; Set C
gaugacguuaccucgugc

SEQ ID NO: 70296 - RNA, 20 nt, Artificial Sequence
  Synthetic Oligonucleotide; PD-1 target exon 3; Set B
ggaugacguuaccucgugcg

SEQ ID NO: 70297 - RNA, 25 nt, Artificial Sequence
  Synthetic Oligonucleotide; PD-1 target exon 3; Set C
cugggaugacguuaccucgugcggc

SEQ ID NO: 70298 - RNA, 17 nt, Artificial Sequence
  Synthetic Oligonucleotide; PD-1 target exon 3; Set C
gaugacguuaccucgug

SEQ ID NO: 70299 - RNA, 19 nt, Artificial Sequence
  Synthetic Oligonucleotide; PD-1 target exon 3; Set B
ggaugacguuaccucgugc

SEQ ID NO: 70300 - RNA, 21 nt, Artificial Sequence
  Synthetic Oligonucleotide; PD-1 target exon 3; Set B
gggaugacguuaccucgugcg

SEQ ID NO: 70301 - RNA, 26 nt, Artificial Sequence
  Synthetic Oligonucleotide; PD-1 target exon 3; Set C
gcugggaugacguuaccucgugcggc

SEQ ID NO: 70302 - RNA, 18 nt, Artificial Sequence
  Synthetic Oligonucleotide; PD-1 target exon 3; Set C
ggaugacguuaccucgug

SEQ ID NO: 70303 - RNA, 22 nt, Artificial Sequence
  Synthetic Oligonucleotide; PD-1 target exon 3; Set B
ugggaugacguuaccucgugcg

SEQ ID NO: 70304 - RNA, 27 nt, Artificial Sequence
  Synthetic Oligonucleotide; PD-1 target exon 3; Set C
ggcugggaugacguuaccucgugcggc

SEQ ID NO: 70305 - RNA, 19 nt, Artificial Sequence
  Synthetic Oligonucleotide; PD-1 target exon 3; Set B
gggaugacguuaccucgug

SEQ ID NO: 70306 - RNA, 21 nt, Artificial Sequence
  Synthetic Oligonucleotide; PD-1 target exon 3; Set B
ugggaugacguuaccucgugc

SEQ ID NO: 70307 - RNA, 20 nt, Artificial Sequence
  Synthetic Oligonucleotide; PD-1 target exon 3; Set B
ugggaugacguuaccucgug

SEQ ID NO: 70308 - RNA, 24 nt, Artificial Sequence
  Synthetic Oligonucleotide; PD-1 target exon 3; Set C
gcugggaugacguuaccucgugcg

SEQ ID NO: 70309 - RNA, 21 nt, Artificial Sequence
  Synthetic Oligonucleotide; PD-1 target exon 3; Set B
cugggaugacguuaccucgug

SEQ ID NO: 70310 - RNA, 25 nt, Artificial Sequence
  Synthetic Oligonucleotide; PD-1 target exon 3; Set C
ggcugggaugacguuaccucgugcg

SEQ ID NO: 70311 - RNA, 22 nt, Artificial Sequence
  Synthetic Oligonucleotide; PD-1 target exon 3; Set B
gcugggaugacguuaccucgug

SEQ ID NO: 70312 - RNA, 24 nt, Artificial Sequence
  Synthetic Oligonucleotide; PD-1 target exon 3; Set C
ggcugggaugacguuaccucgugc

SEQ ID NO: 70313 - RNA, 23 nt, Artificial Sequence
  Synthetic Oligonucleotide; PD-1 target exon 3; Set C
ggcugggaugacguuaccucgug

SEQ ID NO: 70314 - RNA, 26 nt, Artificial Sequence
  Synthetic Oligonucleotide; PD-1 target exon 3; Set C
gcaggccgaggggcugggaugacguu

SEQ ID NO: 70315 - RNA, 34 nt, Artificial Sequence
  Synthetic Oligonucleotide; PD-1 target exon 3; Set C
cagggcaggccgaggggcugggaugacguuaccu

SEQ ID NO: 70316 - RNA, 36 nt, Artificial Sequence
  Synthetic Oligonucleotide; PD-1 target exon 3; Set C
gcagggcaggccgaggggcugggaugacguuaccuc

SEQ ID NO: 70317 - RNA, 33 nt, Artificial Sequence
  Synthetic Oligonucleotide; PD-1 target exon 3; Set C
cagggcaggccgaggggcugggaugacguuacc

SEQ ID NO: 70318 - RNA, 37 nt, Artificial Sequence
  Synthetic Oligonucleotide; PD-1 target exon 3; Set C
ggcagggcaggccgaggggcugggaugacguuaccuc

SEQ ID NO: 70319 - RNA, 32 nt, Artificial Sequence
  Synthetic Oligonucleotide; PD-1 target exon 3; Set C
cagggcaggccgaggggcugggaugacguuac

SEQ ID NO: 70320 - RNA, 17 nt, Artificial Sequence
  Synthetic Oligonucleotide; PD-1 target exon 3; Set B
cagggcaggccgagggg

SEQ ID NO: 70321 - RNA, 16 nt, Artificial Sequence
  Synthetic Oligonucleotide; PD-1 target exon 3; Set B
cagggcaggccgaggg

SEQ ID NO: 70322 - RNA, 15 nt, Artificial Sequence
  Synthetic Oligonucleotide; PD-1 target exon 3; Set B
cagggcaggccgagg

SEQ ID NO: 70323 - RNA, 35 nt, Artificial Sequence
  Synthetic Oligonucleotide; PD-1 target exon 3; Set C
cagcaggguuagggcagggcaggccgaggggcugg

SEQ ID NO: 70324 - RNA, 34 nt, Artificial Sequence
  Synthetic Oligonucleotide; PD-1 target exon 3; Set C
cagcaggguuagggcagggcaggccgaggggcug

SEQ ID NO: 70325 - RNA, 33 nt, Artificial Sequence
  Synthetic Oligonucleotide; PD-1 target exon 3; Set C
cagcaggguuagggcagggcaggccgaggggcu

SEQ ID NO: 70326 - RNA, 32 nt, Artificial Sequence
  Synthetic Oligonucleotide; PD-1 target exon 3; Set C
cagcaggguuagggcagggcaggccgaggggc

SEQ ID NO: 70327 - RNA, 15 nt, Artificial Sequence
  Synthetic Oligonucleotide; PD-1 target exon 3; Set A
cggggucagggugga

SEQ ID NO: 70328 - RNA, 16 nt, Artificial Sequence
  Synthetic Oligonucleotide; PD-1 target exon 3; Set A
acggggucagggugga

SEQ ID NO: 70329 - RNA, 17 nt, Artificial Sequence
  Synthetic Oligonucleotide; PD-1 target exon 3; Set A
gacggggucagggugga

SEQ ID NO: 70330 - RNA, 15 nt, Artificial Sequence
  Synthetic Oligonucleotide; PD-1 target exon 3; Set C
acggggucagggugg

SEQ ID NO: 70331 - RNA, 18 nt, Artificial Sequence
  Synthetic Oligonucleotide; PD-1 target exon 3; Set C
ggacggggucagggugga

SEQ ID NO: 70332 - RNA, 16 nt, Artificial Sequence
  Synthetic Oligonucleotide; PD-1 target exon 3; Set A
gacggggucagggugg

SEQ ID NO: 70333 - RNA, 15 nt, Artificial Sequence
  Synthetic Oligonucleotide; PD-1 target exon 3; Set C
gacggggucagggug

SEQ ID NO: 70334 - RNA, 17 nt, Artificial Sequence
  Synthetic Oligonucleotide; PD-1 target exon 3; Set A
ggacggggucagggugg

SEQ ID NO: 70335 - RNA, 16 nt, Artificial Sequence
  Synthetic Oligonucleotide; PD-1 target exon 3; Set A
ggacggggucagggug

SEQ ID NO: 70336 - RNA, 25 nt, Artificial Sequence
  Synthetic Oligonucleotide; PD-1 target exon 3; Set C
gggguuaggacggggucagggugga

SEQ ID NO: 70337 - RNA, 26 nt, Artificial Sequence
  Synthetic Oligonucleotide; PD-1 target exon 3; Set C
agggguuaggacggggucagggugga

SEQ ID NO: 70338 - RNA, 24 nt, Artificial Sequence
  Synthetic Oligonucleotide; PD-1 target exon 3; Set C
gggguuaggacggggucagggugg

SEQ ID NO: 70339 - RNA, 27 nt, Artificial Sequence
  Synthetic Oligonucleotide; PD-1 target exon 3; Set C
cagggguuaggacggggucagggugga

SEQ ID NO: 70340 - RNA, 23 nt, Artificial Sequence
  Synthetic Oligonucleotide; PD-1 target exon 3; Set C
gggguuaggacggggucagggug

SEQ ID NO: 70341 - RNA, 25 nt, Artificial Sequence
  Synthetic Oligonucleotide; PD-1 target exon 3; Set C
agggguuaggacggggucagggugg

SEQ ID NO: 70342 - RNA, 28 nt, Artificial Sequence
  Synthetic Oligonucleotide; PD-1 target exon 3; Set C
ucagggguuaggacggggucagggugga

SEQ ID NO: 70343 - RNA, 24 nt, Artificial Sequence
  Synthetic Oligonucleotide; PD-1 target exon 3; Set C
agggguuaggacggggucagggug

SEQ ID NO: 70344 - RNA, 29 nt, Artificial Sequence
  Synthetic Oligonucleotide; PD-1 target exon 3; Set C
gucagggguuaggacggggucagggugga

SEQ ID NO: 70345 - RNA, 27 nt, Artificial Sequence
  Synthetic Oligonucleotide; PD-1 target exon 3; Set C
ucagggguuaggacggggucagggugg

SEQ ID NO: 70346 - RNA, 26 nt, Artificial Sequence
  Synthetic Oligonucleotide; PD-1 target exon 3; Set C
ucagggguuaggacggggucagggug

SEQ ID NO: 70347 - RNA, 28 nt, Artificial Sequence
  Synthetic Oligonucleotide; PD-1 target exon 3; Set C
gucagggguuaggacggggucagggugg

SEQ ID NO: 70348 - RNA, 27 nt, Artificial Sequence
  Synthetic Oligonucleotide; PD-1 target exon 3; Set C
gucagggguuaggacggggucagggug

SEQ ID NO: 70349 - RNA, 30 nt, Artificial Sequence
  Synthetic Oligonucleotide; PD-1 target exon 3; Set C
aggucagggguuaggacggggucagggugg

SEQ ID NO: 70350 - RNA, 31 nt, Artificial Sequence
  Synthetic Oligonucleotide; PD-1 target exon 3; Set C
aaggucagggguuaggacggggucagggugg

SEQ ID NO: 70351 - RNA, 30 nt, Artificial Sequence
  Synthetic Oligonucleotide; PD-1 target exon 3; Set C
aaggucagggguuaggacggggucagggug

SEQ ID NO: 70352 - RNA, 26 nt, Artificial Sequence
  Synthetic Oligonucleotide; PD-1 target exon 3; Set C
aaaggucagggguuaggacgggguca

SEQ ID NO: 70353 - RNA, 27 nt, Artificial Sequence
  Synthetic Oligonucleotide; PD-1 target exon 3; Set C
caaaggucagggguuaggacgggguca

SEQ ID NO: 70354 - RNA, 25 nt, Artificial Sequence
  Synthetic Oligonucleotide; PD-1 target exon 3; Set C
aaaggucagggguuaggacgggguc

SEQ ID NO: 70355 - RNA, 26 nt, Artificial Sequence
  Synthetic Oligonucleotide; PD-1 target exon 3; Set C
caaaggucagggguuaggacgggguc

SEQ ID NO: 70356 - RNA, 20 nt, Artificial Sequence
  Synthetic Oligonucleotide; PD-1 target exon 3; Set C
aaaggucagggguuaggacg

SEQ ID NO: 70357 - RNA, 22 nt, Artificial Sequence
  Synthetic Oligonucleotide; PD-1 target exon 3; Set A
caaaggucagggguuaggacgg

SEQ ID NO: 70358 - RNA, 19 nt, Artificial Sequence
  Synthetic Oligonucleotide; PD-1 target exon 3; Set C
aaaggucagggguuaggac

SEQ ID NO: 70359 - RNA, 21 nt, Artificial Sequence
  Synthetic Oligonucleotide; PD-1 target exon 3; Set A
caaaggucagggguuaggacg

SEQ ID NO: 70360 - RNA, 18 nt, Artificial Sequence
  Synthetic Oligonucleotide; PD-1 target exon 3; Set C
aaaggucagggguuagga

SEQ ID NO: 70361 - RNA, 20 nt, Artificial Sequence
  Synthetic Oligonucleotide; PD-1 target exon 3; Set C
caaaggucagggguuaggac

SEQ ID NO: 70362 - RNA, 19 nt, Artificial Sequence
  Synthetic Oligonucleotide; PD-1 target exon 3; Set C
caaaggucagggguuagga

SEQ ID NO: 70363 - RNA, 40 nt, Artificial Sequence
  Synthetic Oligonucleotide; PD-1 target exon 3; Set C
uucugcccuucucucuggaagggcacaaaggucagggguu

SEQ ID NO: 70364 - RNA, 40 nt, Artificial Sequence
  Synthetic Oligonucleotide; PD-1 target exon 3; Set C
acuucugcccuucucucuggaagggcacaaaggucagggg

SEQ ID NO: 70365 - RNA, 39 nt, Artificial Sequence
  Synthetic Oligonucleotide; PD-1 target exon 3; Set C
ugggcacuucugcccuucucucuggaagggcacaaaggu

SEQ ID NO: 70366 - RNA, 38 nt, Artificial Sequence
  Synthetic Oligonucleotide; PD-1 target exon 3; Set C
gugggcacuucugcccuucucucuggaagggcacaaag

SEQ ID NO: 70367 - RNA, 23 nt, Artificial Sequence
  Synthetic Oligonucleotide; PD-1 target exon 3; Set C
gggcacuucugcccuucucucug

SEQ ID NO: 70368 - RNA, 22 nt, Artificial Sequence
  Synthetic Oligonucleotide; PD-1 target exon 3; Set C
gggcacuucugcccuucucucu

SEQ ID NO: 70369 - RNA, 27 nt, Artificial Sequence
  Synthetic Oligonucleotide; PD-1 target exon 3; Set C
gaggggcuggggugggcugugggcacu

SEQ ID NO: 70370 - RNA, 28 nt, Artificial Sequence
  Synthetic Oligonucleotide; PD-1 target exon 3; Set C
ugaggggcuggggugggcugugggcacu

SEQ ID NO: 70371 - RNA, 29 nt, Artificial Sequence
  Synthetic Oligonucleotide; PD-1 target exon 3; Set C
gugaggggcuggggugggcugugggcacu

SEQ ID NO: 70372 - RNA, 34 nt, Artificial Sequence
  Synthetic Oligonucleotide; PD-1 target exon 3; Set C
ugggugaggggcuggggugggcugugggcacuuc

SEQ ID NO: 70373 - RNA, 35 nt, Artificial Sequence
  Synthetic Oligonucleotide; PD-1 target exon 3; Set C
cugggugaggggcuggggugggcugugggcacuuc

SEQ ID NO: 70374 - RNA, 33 nt, Artificial Sequence
  Synthetic Oligonucleotide; PD-1 target exon 3; Set C
ugggugaggggcuggggugggcugugggcacuu

SEQ ID NO: 70375 - RNA, 20 nt, Artificial Sequence
  Synthetic Oligonucleotide; PD-1 target exon 3; Set C
aggggcuggggugggcugug

SEQ ID NO: 70376 - RNA, 22 nt, Artificial Sequence
  Synthetic Oligonucleotide; PD-1 target exon 3; Set C
gaggggcuggggugggcugugg

SEQ ID NO: 70377 - RNA, 34 nt, Artificial Sequence
  Synthetic Oligonucleotide; PD-1 target exon 3; Set C
cugggugaggggcuggggugggcugugggcacuu

SEQ ID NO: 70378 - RNA, 19 nt, Artificial Sequence
  Synthetic Oligonucleotide; PD-1 target exon 3; Set C
aggggcuggggugggcugu

SEQ ID NO: 70379 - RNA, 23 nt, Artificial Sequence
  Synthetic Oligonucleotide; PD-1 target exon 3; Set C
ugaggggcuggggugggcugugg

SEQ ID NO: 70380 - RNA, 31 nt, Artificial Sequence
  Synthetic Oligonucleotide; PD-1 target exon 3; Set C
ugggugaggggcuggggugggcugugggcac

SEQ ID NO: 70381 - RNA, 24 nt, Artificial Sequence
  Synthetic Oligonucleotide; PD-1 target exon 3; Set C
gugaggggcuggggugggcugugg

SEQ ID NO: 70382 - RNA, 32 nt, Artificial Sequence
  Synthetic Oligonucleotide; PD-1 target exon 3; Set C
cugggugaggggcuggggugggcugugggcac

SEQ ID NO: 70383 - RNA, 30 nt, Artificial Sequence
  Synthetic Oligonucleotide; PD-1 target exon 3; Set C
ugggugaggggcuggggugggcugugggca

SEQ ID NO: 70384 - RNA, 31 nt, Artificial Sequence
  Synthetic Oligonucleotide; PD-1 target exon 3; Set C
cugggugaggggcuggggugggcugugggca

SEQ ID NO: 70385 - RNA, 28 nt, Artificial Sequence
  Synthetic Oligonucleotide; PD-1 target exon 3; Set C
ugggugaggggcuggggugggcuguggg

SEQ ID NO: 70386 - RNA, 21 nt, Artificial Sequence
  Synthetic Oligonucleotide; PD-1 target exon 3; Set C
gugaggggcuggggugggcug

SEQ ID NO: 70387 - RNA, 29 nt, Artificial Sequence
  Synthetic Oligonucleotide; PD-1 target exon 3; Set C
cugggugaggggcuggggugggcuguggg

SEQ ID NO: 70388 - RNA, 22 nt, Artificial Sequence
  Synthetic Oligonucleotide; PD-1 target exon 3; Set C
ggugaggggcuggggugggcug

SEQ ID NO: 70389 - RNA, 23 nt, Artificial Sequence
  Synthetic Oligonucleotide; PD-1 target exon 3; Set C
gggugaggggcuggggugggcug

SEQ ID NO: 70390 - RNA, 33 nt, Artificial Sequence
  Synthetic Oligonucleotide; PD-1 target exon 3; Set C
gcuggccugggugaggggcuggggugggcugug

SEQ ID NO: 70391 - RNA, 32 nt, Artificial Sequence
  Synthetic Oligonucleotide; PD-1 target exon 3; Set C
gcuggccugggugaggggcuggggugggcugu

SEQ ID NO: 70392 - RNA, 34 nt, Artificial Sequence
  Synthetic Oligonucleotide; PD-1 target exon 3; Set C
ggcuggccugggugaggggcuggggugggcugug

SEQ ID NO: 70393 - RNA, 33 nt, Artificial Sequence
  Synthetic Oligonucleotide; PD-1 target exon 3; Set C
ggcuggccugggugaggggcuggggugggcugu

SEQ ID NO: 70394 - RNA, 40 nt, Artificial Sequence
  Synthetic Oligonucleotide; PD-1 target exon 3; Set C
acuggccggcuggccugggugaggggcuggggugggcugu

SEQ ID NO: 70395 - RNA, 24 nt, Artificial Sequence
  Synthetic Oligonucleotide; PD-1 target exon 3; Set C
gcuggccugggugaggggcugggg

SEQ ID NO: 70396 - RNA, 25 nt, Artificial Sequence
  Synthetic Oligonucleotide; PD-1 target exon 3; Set C
ggcuggccugggugaggggcugggg

SEQ ID NO: 70397 - RNA, 32 nt, Artificial Sequence
  Synthetic Oligonucleotide; PD-1 target exon 3; Set C
acuggccggcuggccugggugaggggcugggg

SEQ ID NO: 70398 - RNA, 16 nt, Artificial Sequence
  Synthetic Oligonucleotide; PD-1 target exon 3; Set A
gcuggccugggugagg

SEQ ID NO: 70399 - RNA, 33 nt, Artificial Sequence
  Synthetic Oligonucleotide; PD-1 target exon 3; Set C
aacuggccggcuggccugggugaggggcugggg

SEQ ID NO: 70400 - RNA, 17 nt, Artificial Sequence
  Synthetic Oligonucleotide; PD-1 target exon 3; Set A
ggcuggccugggugagg

SEQ ID NO: 70401 - RNA, 24 nt, Artificial Sequence
  Synthetic Oligonucleotide; PD-1 target exon 3; Set C
acuggccggcuggccugggugagg

SEQ ID NO: 70402 - RNA, 25 nt, Artificial Sequence
  Synthetic Oligonucleotide; PD-1 target exon 3; Set C
aacuggccggcuggccugggugagg

SEQ ID NO: 70403 - RNA, 35 nt, Artificial Sequence
  Synthetic Oligonucleotide; PD-1 target exon 3; Set C
gguuuggaacuggccggcuggccugggugaggggc

SEQ ID NO: 70404 - RNA, 27 nt, Artificial Sequence
  Synthetic Oligonucleotide; PD-1 target exon 3; Set C
ggguuuggaacuggccggcuggccugg

SEQ ID NO: 70405 - RNA, 26 nt, Artificial Sequence
  Synthetic Oligonucleotide; PD-1 target exon 3; Set C
ggguuuggaacuggccggcuggccug

SEQ ID NO: 70406 - RNA, 16 nt, Artificial Sequence
  Synthetic Oligonucleotide; PD-1 target exon 3; Set A
uggaacuggccggcug

SEQ ID NO: 70407 - RNA, 17 nt, Artificial Sequence
  Synthetic Oligonucleotide; PD-1 target exon 3; Set A
uuggaacuggccggcug

SEQ ID NO: 70408 - RNA, 18 nt, Artificial Sequence
  Synthetic Oligonucleotide; PD-1 target exon 3; Set A
uuuggaacuggccggcug

SEQ ID NO: 70409 - RNA, 19 nt, Artificial Sequence
  Synthetic Oligonucleotide; PD-1 target exon 3; Set A
guuuggaacuggccggcug

SEQ ID NO: 70410 - RNA, 20 nt, Artificial Sequence
  Synthetic Oligonucleotide; PD-1 target exon 3; Set A
gguuuggaacuggccggcug

SEQ ID NO: 70411 - RNA, 33 nt, Artificial Sequence
  Synthetic Oligonucleotide; PD-1 target exon 3; Set C
acaccaaccaccaggguuuggaacuggccggcu

SEQ ID NO: 70412 - RNA, 32 nt, Artificial Sequence
  Synthetic Oligonucleotide; PD-1 target exon 3; Set C
ccgcccacgacaccaaccaccaggguuuggaa

SEQ ID NO: 70413 - RNA, 33 nt, Artificial Sequence
  Synthetic Oligonucleotide; PD-1 target exon 3; Set C
gccgcccacgacaccaaccaccaggguuuggaa

SEQ ID NO: 70414 - RNA, 37 nt, Artificial Sequence
  Synthetic Oligonucleotide; PD-1 target exon 3; Set C
aggccgcccacgacaccaaccaccaggguuuggaacu

SEQ ID NO: 70415 - RNA, 32 nt, Artificial Sequence
  Synthetic Oligonucleotide; PD-1 target exon 3; Set C
gccgcccacgacaccaaccaccaggguuugga

SEQ ID NO: 70416 - RNA, 36 nt, Artificial Sequence
  Synthetic Oligonucleotide; PD-1 target exon 3; Set C
aggccgcccacgacaccaaccaccaggguuuggaac

SEQ ID NO: 70417 - RNA, 31 nt, Artificial Sequence
  Synthetic Oligonucleotide; PD-1 target exon 3; Set C
gccgcccacgacaccaaccaccaggguuugg

SEQ ID NO: 70418 - RNA, 30 nt, Artificial Sequence
  Synthetic Oligonucleotide; PD-1 target exon 3; Set C
gccgcccacgacaccaaccaccaggguuug

SEQ ID NO: 70419 - RNA, 29 nt, Artificial Sequence
  Synthetic Oligonucleotide; PD-1 target exon 3; Set C
gccgcccacgacaccaaccaccaggguuu

SEQ ID NO: 70420 - RNA, 28 nt, Artificial Sequence
  Synthetic Oligonucleotide; PD-1 target exon 3; Set C
gccgcccacgacaccaaccaccaggguu

SEQ ID NO: 70421 - RNA, 40 nt, Artificial Sequence
  Synthetic Oligonucleotide; PD-1 target exon 3; Set C
gcugcccagcaggccgcccacgacaccaaccaccaggguu

SEQ ID NO: 70422 - RNA, 39 nt, Artificial Sequence
  Synthetic Oligonucleotide; PD-1 target exon 3; Set C
gcugcccagcaggccgcccacgacaccaaccaccagggu

SEQ ID NO: 70423 - RNA, 40 nt, Artificial Sequence
  Synthetic Oligonucleotide; PD-1 target exon 3; Set C
ggcugcccagcaggccgcccacgacaccaaccaccagggu

SEQ ID NO: 70424 - RNA, 24 nt, Artificial Sequence
  Synthetic Oligonucleotide; PD-1 target exon 3; Set C
gcugcccagcaggccgcccacgac

SEQ ID NO: 70425 - RNA, 25 nt, Artificial Sequence
  Synthetic Oligonucleotide; PD-1 target exon 3; Set C
ggcugcccagcaggccgcccacgac

SEQ ID NO: 70426 - RNA, 26 nt, Artificial Sequence
  Synthetic Oligonucleotide; PD-1 target exon 3; Set C
aggcugcccagcaggccgcccacgac

SEQ ID NO: 70427 - RNA, 37 nt, Artificial Sequence
  Synthetic Oligonucleotide; PD-1 target exon 3; Set C
cuagcagcaccaggcugcccagcaggccgcccacgac

SEQ ID NO: 70428 - RNA, 35 nt, Artificial Sequence
  Synthetic Oligonucleotide; PD-1 target exon 3; Set C
uagcagcaccaggcugcccagcaggccgcccacga

SEQ ID NO: 70429 - RNA, 38 nt, Artificial Sequence
  Synthetic Oligonucleotide; PD-1 target exon 3; Set C
acuagcagcaccaggcugcccagcaggccgcccacgac

SEQ ID NO: 70430 - RNA, 39 nt, Artificial Sequence
  Synthetic Oligonucleotide; PD-1 target exon 3; Set C
gacuagcagcaccaggcugcccagcaggccgcccacgac

SEQ ID NO: 70431 - RNA, 30 nt, Artificial Sequence
  Synthetic Oligonucleotide; PD-1 target exon 3; Set C
cagacuagcagcaccaggcugcccagcagg

SEQ ID NO: 70432 - RNA, 32 nt, Artificial Sequence
  Synthetic Oligonucleotide; PD-1 target exon 3; Set C
acggccaggacccagacuagcagcaccaggcu

SEQ ID NO: 70433 - RNA, 33 nt, Artificial Sequence
  Synthetic Oligonucleotide; PD-1 target exon 3; Set C
gacggccaggacccagacuagcagcaccaggcu

SEQ ID NO: 70434 - RNA, 31 nt, Artificial Sequence
  Synthetic Oligonucleotide; PD-1 target exon 3; Set C
acggccaggacccagacuagcagcaccaggc

SEQ ID NO: 70435 - RNA, 35 nt, Artificial Sequence
  Synthetic Oligonucleotide; PD-1 target exon 3; Set C
ugacggccaggacccagacuagcagcaccaggcug

SEQ ID NO: 70436 - RNA, 30 nt, Artificial Sequence
  Synthetic Oligonucleotide; PD-1 target exon 3; Set C
acggccaggacccagacuagcagcaccagg

SEQ ID NO: 70437 - RNA, 32 nt, Artificial Sequence
  Synthetic Oligonucleotide; PD-1 target exon 3; Set C
gacggccaggacccagacuagcagcaccaggc

SEQ ID NO: 70438 - RNA, 36 nt, Artificial Sequence
  Synthetic Oligonucleotide; PD-1 target exon 3; Set C
augacggccaggacccagacuagcagcaccaggcug

SEQ ID NO: 70439 - RNA, 37 nt, Artificial Sequence
  Synthetic Oligonucleotide; PD-1 target exon 3; Set C
gaugacggccaggacccagacuagcagcaccaggcug

SEQ ID NO: 70440 - RNA, 38 nt, Artificial Sequence
  Synthetic Oligonucleotide; PD-1 target exon 3; Set C
agaugacggccaggacccagacuagcagcaccaggcug

SEQ ID NO: 70441 - RNA, 31 nt, Artificial Sequence
  Synthetic Oligonucleotide; PD-1 target exon 3; Set C
ugacggccaggacccagacuagcagcaccag

SEQ ID NO: 70442 - RNA, 39 nt, Artificial Sequence
  Synthetic Oligonucleotide; PD-1 target exon 3; Set C
cagaugacggccaggacccagacuagcagcaccaggcug

SEQ ID NO: 70443 - RNA, 32 nt, Artificial Sequence
  Synthetic Oligonucleotide; PD-1 target exon 3; Set C
augacggccaggacccagacuagcagcaccag

SEQ ID NO: 70444 - RNA, 40 nt, Artificial Sequence
  Synthetic Oligonucleotide; PD-1 target exon 3; Set C
gcagaugacggccaggacccagacuagcagcaccaggcug

SEQ ID NO: 70445 - RNA, 30 nt, Artificial Sequence
  Synthetic Oligonucleotide; PD-1 target exon 3; Set C
ugacggccaggacccagacuagcagcacca

SEQ ID NO: 70446 - RNA, 33 nt, Artificial Sequence
  Synthetic Oligonucleotide; PD-1 target exon 3; Set C
gaugacggccaggacccagacuagcagcaccag

SEQ ID NO: 70447 - RNA, 29 nt, Artificial Sequence
  Synthetic Oligonucleotide; PD-1 target exon 3; Set C
ugacggccaggacccagacuagcagcacc

SEQ ID NO: 70448 - RNA, 31 nt, Artificial Sequence
  Synthetic Oligonucleotide; PD-1 target exon 3; Set C
augacggccaggacccagacuagcagcacca

SEQ ID NO: 70449 - RNA, 34 nt, Artificial Sequence
  Synthetic Oligonucleotide; PD-1 target exon 3; Set C
agaugacggccaggacccagacuagcagcaccag

SEQ ID NO: 70450 - RNA, 30 nt, Artificial Sequence
  Synthetic Oligonucleotide; PD-1 target exon 3; Set C
augacggccaggacccagacuagcagcacc

SEQ ID NO: 70451 - RNA, 32 nt, Artificial Sequence
  Synthetic Oligonucleotide; PD-1 target exon 3; Set C
gaugacggccaggacccagacuagcagcacca

SEQ ID NO: 70452 - RNA, 35 nt, Artificial Sequence
  Synthetic Oligonucleotide; PD-1 target exon 3; Set C
cagaugacggccaggacccagacuagcagcaccag

SEQ ID NO: 70453 - RNA, 31 nt, Artificial Sequence
  Synthetic Oligonucleotide; PD-1 target exon 3; Set C
gaugacggccaggacccagacuagcagcacc

SEQ ID NO: 70454 - RNA, 33 nt, Artificial Sequence
  Synthetic Oligonucleotide; PD-1 target exon 3; Set C
agaugacggccaggacccagacuagcagcacca

SEQ ID NO: 70455 - RNA, 36 nt, Artificial Sequence
  Synthetic Oligonucleotide; PD-1 target exon 3; Set C
gcagaugacggccaggacccagacuagcagcaccag

SEQ ID NO: 70456 - RNA, 32 nt, Artificial Sequence
  Synthetic Oligonucleotide; PD-1 target exon 3; Set C
agaugacggccaggacccagacuagcagcacc

SEQ ID NO: 70457 - RNA, 34 nt, Artificial Sequence
  Synthetic Oligonucleotide; PD-1 target exon 3; Set C
cagaugacggccaggacccagacuagcagcacca

SEQ ID NO: 70458 - RNA, 37 nt, Artificial Sequence
  Synthetic Oligonucleotide; PD-1 target exon 3; Set C
agcagaugacggccaggacccagacuagcagcaccag

SEQ ID NO: 70459 - RNA, 21 nt, Artificial Sequence
  Synthetic Oligonucleotide; PD-1 target exon 3; Set C
acggccaggacccagacuagc

SEQ ID NO: 70460 - RNA, 23 nt, Artificial Sequence
  Synthetic Oligonucleotide; PD-1 target exon 3; Set C
gacggccaggacccagacuagca

SEQ ID NO: 70461 - RNA, 33 nt, Artificial Sequence
  Synthetic Oligonucleotide; PD-1 target exon 3; Set C
cagaugacggccaggacccagacuagcagcacc

SEQ ID NO: 70462 - RNA, 35 nt, Artificial Sequence
  Synthetic Oligonucleotide; PD-1 target exon 3; Set C
gcagaugacggccaggacccagacuagcagcacca

SEQ ID NO: 70463 - RNA, 38 nt, Artificial Sequence
  Synthetic Oligonucleotide; PD-1 target exon 3; Set C
gagcagaugacggccaggacccagacuagcagcaccag

SEQ ID NO: 70464 - RNA, 22 nt, Artificial Sequence
  Synthetic Oligonucleotide; PD-1 target exon 3; Set C
gacggccaggacccagacuagc

SEQ ID NO: 70465 - RNA, 24 nt, Artificial Sequence
  Synthetic Oligonucleotide; PD-1 target exon 3; Set C
ugacggccaggacccagacuagca

SEQ ID NO: 70466 - RNA, 34 nt, Artificial Sequence
  Synthetic Oligonucleotide; PD-1 target exon 3; Set C
gcagaugacggccaggacccagacuagcagcacc

SEQ ID NO: 70467 - RNA, 36 nt, Artificial Sequence
  Synthetic Oligonucleotide; PD-1 target exon 3; Set C
agcagaugacggccaggacccagacuagcagcacca

SEQ ID NO: 70468 - RNA, 25 nt, Artificial Sequence
  Synthetic Oligonucleotide; PD-1 target exon 3; Set C
augacggccaggacccagacuagca

SEQ ID NO: 70469 - RNA, 35 nt, Artificial Sequence
  Synthetic Oligonucleotide; PD-1 target exon 3; Set C
agcagaugacggccaggacccagacuagcagcacc

SEQ ID NO: 70470 - RNA, 37 nt, Artificial Sequence
  Synthetic Oligonucleotide; PD-1 target exon 3; Set C
gagcagaugacggccaggacccagacuagcagcacca

SEQ ID NO: 70471 - RNA, 36 nt, Artificial Sequence
  Synthetic Oligonucleotide; PD-1 target exon 3; Set C
gagcagaugacggccaggacccagacuagcagcacc

SEQ ID NO: 70472 - RNA, 38 nt, Artificial Sequence
  Synthetic Oligonucleotide; PD-1 target exon 3; Set C
ggagcagaugacggccaggacccagacuagcagcacca

SEQ ID NO: 70473 - RNA, 17 nt, Artificial Sequence
  Synthetic Oligonucleotide; PD-1 target exon 3; Set A
acggccaggacccagac

SEQ ID NO: 70474 - RNA, 37 nt, Artificial Sequence
  Synthetic Oligonucleotide; PD-1 target exon 3; Set C
ggagcagaugacggccaggacccagacuagcagcacc

SEQ ID NO: 70475 - RNA, 39 nt, Artificial Sequence
  Synthetic Oligonucleotide; PD-1 target exon 3; Set C
gggagcagaugacggccaggacccagacuagcagcacca

SEQ ID NO: 70476 - RNA, 28 nt, Artificial Sequence
  Synthetic Oligonucleotide; PD-1 target exon 3; Set C
cagaugacggccaggacccagacuagca

SEQ ID NO: 70477 - RNA, 38 nt, Artificial Sequence
  Synthetic Oligonucleotide; PD-1 target exon 3; Set C
gggagcagaugacggccaggacccagacuagcagcacc

SEQ ID NO: 70478 - RNA, 40 nt, Artificial Sequence
  Synthetic Oligonucleotide; PD-1 target exon 3; Set C
ccucgugcggcccgggagcagaugacggccaggacccaga

SEQ ID NO: 70479 - RNA, 16 nt, Artificial Sequence
  Synthetic Oligonucleotide; PD-1 target exon 3; Set C
ccgggagcagaugacg

SEQ ID NO: 70480 - RNA, 15 nt, Artificial Sequence
  Synthetic Oligonucleotide; PD-1 target exon 3; Set C
ccgggagcagaugac

SEQ ID NO: 70481 - RNA, 15 nt, Artificial Sequence
  Synthetic Oligonucleotide; PD-1 target exon 3; Set C
cccgggagcagauga

SEQ ID NO: 70482 - RNA, 21 nt, Artificial Sequence
  Synthetic Oligonucleotide; PD-1 target exon 3; Set C
gcggcccgggagcagaugacg

SEQ ID NO: 70483 - RNA, 33 nt, Artificial Sequence
  Synthetic Oligonucleotide; PD-1 target exon 3; Set C
ccucgugcggcccgggagcagaugacggccagg

SEQ ID NO: 70484 - RNA, 18 nt, Artificial Sequence
  Synthetic Oligonucleotide; PD-1 target exon 3; Set B
cggcccgggagcagauga

SEQ ID NO: 70485 - RNA, 22 nt, Artificial Sequence
  Synthetic Oligonucleotide; PD-1 target exon 3; Set C
ugcggcccgggagcagaugacg

SEQ ID NO: 70486 - RNA, 20 nt, Artificial Sequence
  Synthetic Oligonucleotide; PD-1 target exon 3; Set C
gcggcccgggagcagaugac

SEQ ID NO: 70487 - RNA, 34 nt, Artificial Sequence
  Synthetic Oligonucleotide; PD-1 target exon 3; Set C
accucgugcggcccgggagcagaugacggccagg

SEQ ID NO: 70488 - RNA, 23 nt, Artificial Sequence
  Synthetic Oligonucleotide; PD-1 target exon 3; Set C
gugcggcccgggagcagaugacg

SEQ ID NO: 70489 - RNA, 21 nt, Artificial Sequence
  Synthetic Oligonucleotide; PD-1 target exon 3; Set C
ugcggcccgggagcagaugac

SEQ ID NO: 70490 - RNA, 35 nt, Artificial Sequence
  Synthetic Oligonucleotide; PD-1 target exon 3; Set C
uaccucgugcggcccgggagcagaugacggccagg

SEQ ID NO: 70491 - RNA, 18 nt, Artificial Sequence
  Synthetic Oligonucleotide; PD-1 target exon 3; Set C
gcggcccgggagcagaug

SEQ ID NO: 70492 - RNA, 22 nt, Artificial Sequence
  Synthetic Oligonucleotide; PD-1 target exon 3; Set C
gugcggcccgggagcagaugac

SEQ ID NO: 70493 - RNA, 17 nt, Artificial Sequence
  Synthetic Oligonucleotide; PD-1 target exon 3; Set C
gcggcccgggagcagau

SEQ ID NO: 70494 - RNA, 22 nt, Artificial Sequence
  Synthetic Oligonucleotide; PD-1 target exon 3; Set C
cgugcggcccgggagcagauga

SEQ ID NO: 70495 - RNA, 18 nt, Artificial Sequence
  Synthetic Oligonucleotide; PD-1 target exon 3; Set C
ugcggcccgggagcagau

SEQ ID NO: 70496 - RNA, 16 nt, Artificial Sequence
  Synthetic Oligonucleotide; PD-1 target exon 3; Set C
gcggcccgggagcaga

SEQ ID NO: 70497 - RNA, 17 nt, Artificial Sequence
  Synthetic Oligonucleotide; PD-1 target exon 3; Set C
ugcggcccgggagcaga

SEQ ID NO: 70498 - RNA, 15 nt, Artificial Sequence
  Synthetic Oligonucleotide; PD-1 target exon 3; Set B
gcggcccgggagcag

SEQ ID NO: 70499 - RNA, 16 nt, Artificial Sequence
  Synthetic Oligonucleotide; PD-1 target exon 3; Set B
ugcggcccgggagcag

SEQ ID NO: 70500 - RNA, 32 nt, Artificial Sequence
  Synthetic Oligonucleotide; PD-1 target exon 3; Set C
uuaccucgugcggcccgggagcagaugacggc

SEQ ID NO: 70501 - RNA, 17 nt, Artificial Sequence
  Synthetic Oligonucleotide; PD-1 target exon 3; Set C
gugcggcccgggagcag

SEQ ID NO: 70502 - RNA, 15 nt, Artificial Sequence
  Synthetic Oligonucleotide; PD-1 target exon 3; Set C
ugcggcccgggagca

SEQ ID NO: 70503 - RNA, 33 nt, Artificial Sequence
  Synthetic Oligonucleotide; PD-1 target exon 3; Set C
guuaccucgugcggcccgggagcagaugacggc

SEQ ID NO: 70504 - RNA, 16 nt, Artificial Sequence
  Synthetic Oligonucleotide; PD-1 target exon 3; Set C
gugcggcccgggagca

SEQ ID NO: 70505 - RNA, 34 nt, Artificial Sequence
  Synthetic Oligonucleotide; PD-1 target exon 3; Set C
cguuaccucgugcggcccgggagcagaugacggc

SEQ ID NO: 70506 - RNA, 15 nt, Artificial Sequence
  Synthetic Oligonucleotide; PD-1 target exon 3; Set B
gugcggcccgggagc

SEQ ID NO: 70507 - RNA, 35 nt, Artificial Sequence
  Synthetic Oligonucleotide; PD-1 target exon 3; Set C
acguuaccucgugcggcccgggagcagaugacggc

SEQ ID NO: 70508 - RNA, 36 nt, Artificial Sequence
  Synthetic Oligonucleotide; PD-1 target exon 3; Set C
gacguuaccucgugcggcccgggagcagaugacggc

SEQ ID NO: 70509 - RNA, 37 nt, Artificial Sequence
  Synthetic Oligonucleotide; PD-1 target exon 3; Set C
ugacguuaccucgugcggcccgggagcagaugacggc

SEQ ID NO: 70510 - RNA, 18 nt, Artificial Sequence
  Synthetic Oligonucleotide; PD-1 target exon 3; Set C
cucgugcggcccgggagc

SEQ ID NO: 70511 - RNA, 38 nt, Artificial Sequence
  Synthetic Oligonucleotide; PD-1 target exon 3; Set C
augacguuaccucgugcggcccgggagcagaugacggc

SEQ ID NO: 70512 - RNA, 17 nt, Artificial Sequence
  Synthetic Oligonucleotide; PD-1 target exon 3; Set B
cucgugcggcccgggag

SEQ ID NO: 70513 - RNA, 39 nt, Artificial Sequence
  Synthetic Oligonucleotide; PD-1 target exon 3; Set C
gaugacguuaccucgugcggcccgggagcagaugacggc

SEQ ID NO: 70514 - RNA, 16 nt, Artificial Sequence
  Synthetic Oligonucleotide; PD-1 target exon 3; Set C
cucgugcggcccggga

SEQ ID NO: 70515 - RNA, 40 nt, Artificial Sequence
  Synthetic Oligonucleotide; PD-1 target exon 3; Set C
ggaugacguuaccucgugcggcccgggagcagaugacggc

SEQ ID NO: 70516 - RNA, 15 nt, Artificial Sequence
  Synthetic Oligonucleotide; PD-1 target exon 3; Set B
cucgugcggcccggg

SEQ ID NO: 70517 - RNA, 21 nt, Artificial Sequence
  Synthetic Oligonucleotide; PD-1 target exon 3; Set C
acguuaccucgugcggcccgg

SEQ ID NO: 70518 - RNA, 16 nt, Artificial Sequence
  Synthetic Oligonucleotide; PD-1 target exon 3; Set B
guuaccucgugcggcc

SEQ ID NO: 70519 - RNA, 22 nt, Artificial Sequence
  Synthetic Oligonucleotide; PD-1 target exon 3; Set C
gacguuaccucgugcggcccgg

SEQ ID NO: 70520 - RNA, 15 nt, Artificial Sequence
  Synthetic Oligonucleotide; PD-1 target exon 3; Set C
guuaccucgugcggc

SEQ ID NO: 70521 - RNA, 17 nt, Artificial Sequence
  Synthetic Oligonucleotide; PD-1 target exon 3; Set B
cguuaccucgugcggcc

SEQ ID NO: 70522 - RNA, 23 nt, Artificial Sequence
  Synthetic Oligonucleotide; PD-1 target exon 3; Set C
ugacguuaccucgugcggcccgg

SEQ ID NO: 70523 - RNA, 16 nt, Artificial Sequence
  Synthetic Oligonucleotide; PD-1 target exon 3; Set B
cguuaccucgugcggc

SEQ ID NO: 70524 - RNA, 18 nt, Artificial Sequence
  Synthetic Oligonucleotide; PD-1 target exon 3; Set B
acguuaccucgugcggcc

SEQ ID NO: 70525 - RNA, 24 nt, Artificial Sequence
  Synthetic Oligonucleotide; PD-1 target exon 3; Set C
augacguuaccucgugcggcccgg

SEQ ID NO: 70526 - RNA, 17 nt, Artificial Sequence
  Synthetic Oligonucleotide; PD-1 target exon 3; Set B
acguuaccucgugcggc

SEQ ID NO: 70527 - RNA, 19 nt, Artificial Sequence
  Synthetic Oligonucleotide; PD-1 target exon 3; Set C
gacguuaccucgugcggcc

SEQ ID NO: 70528 - RNA, 25 nt, Artificial Sequence
  Synthetic Oligonucleotide; PD-1 target exon 3; Set C
gaugacguuaccucgugcggcccgg

SEQ ID NO: 70529 - RNA, 20 nt, Artificial Sequence
  Synthetic Oligonucleotide; PD-1 target exon 3; Set C
ugacguuaccucgugcggcc

SEQ ID NO: 70530 - RNA, 26 nt, Artificial Sequence
  Synthetic Oligonucleotide; PD-1 target exon 3; Set C
ggaugacguuaccucgugcggcccgg

SEQ ID NO: 70531 - RNA, 15 nt, Artificial Sequence
  Synthetic Oligonucleotide; PD-1 target exon 3; Set C
acguuaccucgugcg

SEQ ID NO: 70532 - RNA, 27 nt, Artificial Sequence
  Synthetic Oligonucleotide; PD-1 target exon 3; Set C
gggaugacguuaccucgugcggcccgg

SEQ ID NO: 70533 - RNA, 28 nt, Artificial Sequence
  Synthetic Oligonucleotide; PD-1 target exon 3; Set C
ugggaugacguuaccucgugcggcccgg

SEQ ID NO: 70534 - RNA, 15 nt, Artificial Sequence
  Synthetic Oligonucleotide; PD-1 target exon 3; Set C
gacguuaccucgugc

SEQ ID NO: 70535 - RNA, 29 nt, Artificial Sequence
  Synthetic Oligonucleotide; PD-1 target exon 3; Set C
cugggaugacguuaccucgugcggcccgg

SEQ ID NO: 70536 - RNA, 19 nt, Artificial Sequence
  Synthetic Oligonucleotide; PD-1 target exon 3; Set B
augacguuaccucgugcgg

SEQ ID NO: 70537 - RNA, 24 nt, Artificial Sequence
  Synthetic Oligonucleotide; PD-1 target exon 3; Set C
gggaugacguuaccucgugcggcc

SEQ ID NO: 70538 - RNA, 30 nt, Artificial Sequence
  Synthetic Oligonucleotide; PD-1 target exon 3; Set C
gcugggaugacguuaccucgugcggcccgg

SEQ ID NO: 70539 - RNA, 20 nt, Artificial Sequence
  Synthetic Oligonucleotide; PD-1 target exon 3; Set B
gaugacguuaccucgugcgg

SEQ ID NO: 70540 - RNA, 25 nt, Artificial Sequence
  Synthetic Oligonucleotide; PD-1 target exon 3; Set C
ugggaugacguuaccucgugcggcc

SEQ ID NO: 70541 - RNA, 31 nt, Artificial Sequence
  Synthetic Oligonucleotide; PD-1 target exon 3; Set C
ggcugggaugacguuaccucgugcggcccgg

SEQ ID NO: 70542 - RNA, 21 nt, Artificial Sequence
  Synthetic Oligonucleotide; PD-1 target exon 3; Set B
ggaugacguuaccucgugcgg

SEQ ID NO: 70543 - RNA, 26 nt, Artificial Sequence
  Synthetic Oligonucleotide; PD-1 target exon 3; Set C
cugggaugacguuaccucgugcggcc

SEQ ID NO: 70544 - RNA, 27 nt, Artificial Sequence
  Synthetic Oligonucleotide; PD-1 target exon 3; Set C
gcugggaugacguuaccucgugcggcc

SEQ ID NO: 70545 - RNA, 15 nt, Artificial Sequence
  Synthetic Oligonucleotide; PD-1 target exon 3; Set C
augacguuaccucgu

SEQ ID NO: 70546 - RNA, 28 nt, Artificial Sequence
  Synthetic Oligonucleotide; PD-1 target exon 3; Set C
ggcugggaugacguuaccucgugcggcc

SEQ ID NO: 70547 - RNA, 20 nt, Artificial Sequence
  Synthetic Oligonucleotide; PD-1 target exon 3; Set B
gggaugacguuaccucgugc

SEQ ID NO: 70548 - RNA, 16 nt, Artificial Sequence
  Synthetic Oligonucleotide; PD-1 target exon 3; Set C
gaugacguuaccucgu

SEQ ID NO: 70549 - RNA, 23 nt, Artificial Sequence
  Synthetic Oligonucleotide; PD-1 target exon 3; Set C
cugggaugacguuaccucgugcg

SEQ ID NO: 70550 - RNA, 17 nt, Artificial Sequence
  Synthetic Oligonucleotide; PD-1 target exon 3; Set C
ggaugacguuaccucgu

SEQ ID NO: 70551 - RNA, 15 nt, Artificial Sequence
  Synthetic Oligonucleotide; PD-1 target exon 3; Set C
gaugacguuaccucg

SEQ ID NO: 70552 - RNA, 22 nt, Artificial Sequence
  Synthetic Oligonucleotide; PD-1 target exon 3; Set B
cugggaugacguuaccucgugc

SEQ ID NO: 70553 - RNA, 18 nt, Artificial Sequence
  Synthetic Oligonucleotide; PD-1 target exon 3; Set B
gggaugacguuaccucgu

SEQ ID NO: 70554 - RNA, 16 nt, Artificial Sequence
  Synthetic Oligonucleotide; PD-1 target exon 3; Set C
ggaugacguuaccucg

SEQ ID NO: 70555 - RNA, 23 nt, Artificial Sequence
  Synthetic Oligonucleotide; PD-1 target exon 3; Set C
gcugggaugacguuaccucgugc

SEQ ID NO: 70556 - RNA, 19 nt, Artificial Sequence
  Synthetic Oligonucleotide; PD-1 target exon 3; Set B
ugggaugacguuaccucgu

SEQ ID NO: 70557 - RNA, 17 nt, Artificial Sequence
  Synthetic Oligonucleotide; PD-1 target exon 3; Set C
gggaugacguuaccucg

SEQ ID NO: 70558 - RNA, 20 nt, Artificial Sequence
  Synthetic Oligonucleotide; PD-1 target exon 3; Set B
cugggaugacguuaccucgu

SEQ ID NO: 70559 - RNA, 18 nt, Artificial Sequence
  Synthetic Oligonucleotide; PD-1 target exon 3; Set C
ugggaugacguuaccucg

SEQ ID NO: 70560 - RNA, 21 nt, Artificial Sequence
  Synthetic Oligonucleotide; PD-1 target exon 3; Set B
gcugggaugacguuaccucgu

SEQ ID NO: 70561 - RNA, 22 nt, Artificial Sequence
  Synthetic Oligonucleotide; PD-1 target exon 3; Set C
ggcugggaugacguuaccucgu

SEQ ID NO: 70562 - RNA, 21 nt, Artificial Sequence
  Synthetic Oligonucleotide; PD-1 target exon 3; Set B
ggcugggaugacguuaccucg

SEQ ID NO: 70563 - RNA, 21 nt, Artificial Sequence
  Synthetic Oligonucleotide; PD-1 target exon 3; Set B
gggcugggaugacguuaccuc

SEQ ID NO: 70564 - RNA, 22 nt, Artificial Sequence
  Synthetic Oligonucleotide; PD-1 target exon 3; Set C
ggggcugggaugacguuaccuc

SEQ ID NO: 70565 - RNA, 23 nt, Artificial Sequence
  Synthetic Oligonucleotide; PD-1 target exon 3; Set C
aggggcugggaugacguuaccuc

SEQ ID NO: 70566 - RNA, 24 nt, Artificial Sequence
  Synthetic Oligonucleotide; PD-1 target exon 3; Set C
gaggggcugggaugacguuaccuc

SEQ ID NO: 70567 - RNA, 29 nt, Artificial Sequence
  Synthetic Oligonucleotide; PD-1 target exon 3; Set C
caggccgaggggcugggaugacguuaccu

SEQ ID NO: 70568 - RNA, 28 nt, Artificial Sequence
  Synthetic Oligonucleotide; PD-1 target exon 3; Set C
caggccgaggggcugggaugacguuacc

SEQ ID NO: 70569 - RNA, 40 nt, Artificial Sequence
  Synthetic Oligonucleotide; PD-1 target exon 3; Set C
gcagggcaggccgaggggcugggaugacguuaccucgugc

SEQ ID NO: 70570 - RNA, 27 nt, Artificial Sequence
  Synthetic Oligonucleotide; PD-1 target exon 3; Set C
caggccgaggggcugggaugacguuac

SEQ ID NO: 70571 - RNA, 39 nt, Artificial Sequence
  Synthetic Oligonucleotide; PD-1 target exon 3; Set C
gcagggcaggccgaggggcugggaugacguuaccucgug

SEQ ID NO: 70572 - RNA, 24 nt, Artificial Sequence
  Synthetic Oligonucleotide; PD-1 target exon 3; Set C
aggccgaggggcugggaugacguu

SEQ ID NO: 70573 - RNA, 40 nt, Artificial Sequence
  Synthetic Oligonucleotide; PD-1 target exon 3; Set C
ggcagggcaggccgaggggcugggaugacguuaccucgug

SEQ ID NO: 70574 - RNA, 23 nt, Artificial Sequence
  Synthetic Oligonucleotide; PD-1 target exon 3; Set C
aggccgaggggcugggaugacgu

SEQ ID NO: 70575 - RNA, 27 nt, Artificial Sequence
  Synthetic Oligonucleotide; PD-1 target exon 3; Set C
gcaggccgaggggcugggaugacguua

SEQ ID NO: 70576 - RNA, 28 nt, Artificial Sequence
  Synthetic Oligonucleotide; PD-1 target exon 3; Set C
ggcaggccgaggggcugggaugacguua

SEQ ID NO: 70577 - RNA, 40 nt, Artificial Sequence
  Synthetic Oligonucleotide; PD-1 target exon 3; Set C
gggcagggcaggccgaggggcugggaugacguuaccucgu

SEQ ID NO: 70578 - RNA, 27 nt, Artificial Sequence
  Synthetic Oligonucleotide; PD-1 target exon 3; Set C
ggcaggccgaggggcugggaugacguu

SEQ ID NO: 70579 - RNA, 25 nt, Artificial Sequence
  Synthetic Oligonucleotide; PD-1 target exon 3; Set C
gcaggccgaggggcugggaugacgu

SEQ ID NO: 70580 - RNA, 24 nt, Artificial Sequence
  Synthetic Oligonucleotide; PD-1 target exon 3; Set C
gcaggccgaggggcugggaugacg

SEQ ID NO: 70581 - RNA, 26 nt, Artificial Sequence
  Synthetic Oligonucleotide; PD-1 target exon 3; Set C
ggcaggccgaggggcugggaugacgu

SEQ ID NO: 70582 - RNA, 30 nt, Artificial Sequence
  Synthetic Oligonucleotide; PD-1 target exon 3; Set C
agggcaggccgaggggcugggaugacguua

SEQ ID NO: 70583 - RNA, 29 nt, Artificial Sequence
  Synthetic Oligonucleotide; PD-1 target exon 3; Set C
agggcaggccgaggggcugggaugacguu

SEQ ID NO: 70584 - RNA, 23 nt, Artificial Sequence
  Synthetic Oligonucleotide; PD-1 target exon 3; Set C
gcaggccgaggggcugggaugac

SEQ ID NO: 70585 - RNA, 25 nt, Artificial Sequence
  Synthetic Oligonucleotide; PD-1 target exon 3; Set C
ggcaggccgaggggcugggaugacg

SEQ ID NO: 70586 - RNA, 22 nt, Artificial Sequence
  Synthetic Oligonucleotide; PD-1 target exon 3; Set C
gcaggccgaggggcugggauga

SEQ ID NO: 70587 - RNA, 24 nt, Artificial Sequence
  Synthetic Oligonucleotide; PD-1 target exon 3; Set C
ggcaggccgaggggcugggaugac

SEQ ID NO: 70588 - RNA, 28 nt, Artificial Sequence
  Synthetic Oligonucleotide; PD-1 target exon 3; Set C
agggcaggccgaggggcugggaugacgu

SEQ ID NO: 70589 - RNA, 23 nt, Artificial Sequence
  Synthetic Oligonucleotide; PD-1 target exon 3; Set C
ggcaggccgaggggcugggauga

SEQ ID NO: 70590 - RNA, 21 nt, Artificial Sequence
  Synthetic Oligonucleotide; PD-1 target exon 3; Set C
gcaggccgaggggcugggaug

SEQ ID NO: 70591 - RNA, 27 nt, Artificial Sequence
  Synthetic Oligonucleotide; PD-1 target exon 3; Set C
agggcaggccgaggggcugggaugacg

SEQ ID NO: 70592 - RNA, 20 nt, Artificial Sequence
  Synthetic Oligonucleotide; PD-1 target exon 3; Set C
gcaggccgaggggcugggau

SEQ ID NO: 70593 - RNA, 26 nt, Artificial Sequence
  Synthetic Oligonucleotide; PD-1 target exon 3; Set C
agggcaggccgaggggcugggaugac

SEQ ID NO: 70594 - RNA, 25 nt, Artificial Sequence
  Synthetic Oligonucleotide; PD-1 target exon 3; Set C
agggcaggccgaggggcugggauga

SEQ ID NO: 70595 - RNA, 19 nt, Artificial Sequence
  Synthetic Oligonucleotide; PD-1 target exon 3; Set C
gcaggccgaggggcuggga

SEQ ID NO: 70596 - RNA, 24 nt, Artificial Sequence
  Synthetic Oligonucleotide; PD-1 target exon 3; Set C
agggcaggccgaggggcugggaug

SEQ ID NO: 70597 - RNA, 23 nt, Artificial Sequence
  Synthetic Oligonucleotide; PD-1 target exon 3; Set C
agggcaggccgaggggcugggau

SEQ ID NO: 70598 - RNA, 22 nt, Artificial Sequence
  Synthetic Oligonucleotide; PD-1 target exon 3; Set C
agggcaggccgaggggcuggga

SEQ ID NO: 70599 - RNA, 40 nt, Artificial Sequence
  Synthetic Oligonucleotide; PD-1 target exon 3; Set C
caggguuagggcagggcaggccgaggggcugggaugacgu

SEQ ID NO: 70600 - RNA, 39 nt, Artificial Sequence
  Synthetic Oligonucleotide; PD-1 target exon 3; Set C
caggguuagggcagggcaggccgaggggcugggaugacg

SEQ ID NO: 70601 - RNA, 38 nt, Artificial Sequence
  Synthetic Oligonucleotide; PD-1 target exon 3; Set C
caggguuagggcagggcaggccgaggggcugggaugac

SEQ ID NO: 70602 - RNA, 15 nt, Artificial Sequence
  Synthetic Oligonucleotide; PD-1 target exon 3; Set B
gguuagggcagggca

SEQ ID NO: 70603 - RNA, 16 nt, Artificial Sequence
  Synthetic Oligonucleotide; CD160 target exon 3; Set B
ggguuagggcagggca

SEQ ID NO: 70604 - RNA, 31 nt, Artificial Sequence
  Synthetic Oligonucleotide; CD160 target exon 3; Set C
cgccagcaggguuagggcagggcaggccgag

SEQ ID NO: 70605 - RNA, 17 nt, Artificial Sequence
  Synthetic Oligonucleotide; CD160 target exon 3; Set B
aggguuagggcagggca

SEQ ID NO: 70606 - RNA, 15 nt, Artificial Sequence
  Synthetic Oligonucleotide; CD160 target exon 3; Set C
agcaggguuagggca

SEQ ID NO: 70607 - RNA, 17 nt, Artificial Sequence
  Synthetic Oligonucleotide; CD160 target exon 3; Set B
cagcaggguuagggcag

SEQ ID NO: 70608 - RNA, 20 nt, Artificial Sequence
  Synthetic Oligonucleotide; CD160 target exon 3; Set C
cgccagcaggguuagggcag

SEQ ID NO: 70609 - RNA, 32 nt, Artificial Sequence
  Synthetic Oligonucleotide; CD160 target exon 3; Set A
ccugcacgcugucagcaggcccaggaacuuga

SEQ ID NO: 70610 - RNA, 29 nt, Artificial Sequence
  Synthetic Oligonucleotide; CD160 target exon 3; Set A
ccugcacgcugucagcaggcccaggaacu

SEQ ID NO: 70611 - RNA, 26 nt, Artificial Sequence
  Synthetic Oligonucleotide; CD160 target exon 3; Set A
ccugcacgcugucagcaggcccagga

SEQ ID NO: 70612 - RNA, 30 nt, Artificial Sequence
  Synthetic Oligonucleotide; CD160 target exon 3; Set A
ccugcacgcugucagcaggcccaggaacuu

SEQ ID NO: 70613 - RNA, 31 nt, Artificial Sequence
  Synthetic Oligonucleotide; CD160 target exon 3; Set A
cugcacgcugucagcaggcccaggaacuuga

SEQ ID NO: 70614 - RNA, 31 nt, Artificial Sequence
  Synthetic Oligonucleotide; CD160 target exon 3; Set A
ccugcacgcugucagcaggcccaggaacuug

SEQ ID NO: 70615 - RNA, 28 nt, Artificial Sequence
  Synthetic Oligonucleotide; CD160 target exon 3; Set A
ccugcacgcugucagcaggcccaggaac

SEQ ID NO: 70616 - RNA, 30 nt, Artificial Sequence
  Synthetic Oligonucleotide; CD160 target exon 3; Set A
ugcacgcugucagcaggcccaggaacuuga

SEQ ID NO: 70617 - RNA, 27 nt, Artificial Sequence
  Synthetic Oligonucleotide; CD160 target exon 3; Set A
ccugcacgcugucagcaggcccaggaa

SEQ ID NO: 70618 - RNA, 28 nt, Artificial Sequence
  Synthetic Oligonucleotide; CD160 target exon 3; Set A
cugcacgcugucagcaggcccaggaacu

SEQ ID NO: 70619 - RNA, 29 nt, Artificial Sequence
  Synthetic Oligonucleotide; CD160 target exon 3; Set A
cugcacgcugucagcaggcccaggaacuu

SEQ ID NO: 70620 - RNA, 27 nt, Artificial Sequence
  Synthetic Oligonucleotide; CD160 target exon 3; Set A
ugcacgcugucagcaggcccaggaacu

SEQ ID NO: 70621 - RNA, 28 nt, Artificial Sequence
  Synthetic Oligonucleotide; CD160 target exon 3; Set A
ugcacgcugucagcaggcccaggaacuu

SEQ ID NO: 70622 - RNA, 30 nt, Artificial Sequence
  Synthetic Oligonucleotide; CD160 target exon 3; Set A
cugcacgcugucagcaggcccaggaacuug

SEQ ID NO: 70623 - RNA, 27 nt, Artificial Sequence
  Synthetic Oligonucleotide; CD160 target exon 3; Set A
cugcacgcugucagcaggcccaggaac

SEQ ID NO: 70624 - RNA, 29 nt, Artificial Sequence
  Synthetic Oligonucleotide; CD160 target exon 3; Set A
ugcacgcugucagcaggcccaggaacuug

SEQ ID NO: 70625 - RNA, 26 nt, Artificial Sequence
  Synthetic Oligonucleotide; CD160 target exon 3; Set A
cugcacgcugucagcaggcccaggaa

SEQ ID NO: 70626 - RNA, 26 nt, Artificial Sequence
  Synthetic Oligonucleotide; CD160 target exon 3; Set A
ugcacgcugucagcaggcccaggaac

SEQ ID NO: 70627 - RNA, 25 nt, Artificial Sequence
  Synthetic Oligonucleotide; CD160 target exon 3; Set A
ugcacgcugucagcaggcccaggaa

SEQ ID NO: 70628 - RNA, 24 nt, Artificial Sequence
  Synthetic Oligonucleotide; CD160 target exon 3; Set A
caggaacuugaagcaaauguuggc

SEQ ID NO: 70629 - RNA, 23 nt, Artificial Sequence
  Synthetic Oligonucleotide; CD160 target exon 3; Set A
aggaacuugaagcaaauguuggc

SEQ ID NO: 70630 - RNA, 22 nt, Artificial Sequence
  Synthetic Oligonucleotide; CD160 target exon 3; Set A
ggaacuugaagcaaauguuggc

SEQ ID NO: 70631 - RNA, 23 nt, Artificial Sequence
  Synthetic Oligonucleotide; CD160 target exon 3; Set A
caggaacuugaagcaaauguugg

SEQ ID NO: 70632 - RNA, 21 nt, Artificial Sequence
  Synthetic Oligonucleotide; CD160 target exon 3; Set A
gaacuugaagcaaauguuggc

SEQ ID NO: 70633 - RNA, 22 nt, Artificial Sequence
  Synthetic Oligonucleotide; CD160 target exon 3; Set A
aggaacuugaagcaaauguugg

SEQ ID NO: 70634 - RNA, 21 nt, Artificial Sequence
  Synthetic Oligonucleotide; CD160 target exon 3; Set A
ggaacuugaagcaaauguugg

SEQ ID NO: 70635 - RNA, 22 nt, Artificial Sequence
  Synthetic Oligonucleotide; CD160 target exon 3; Set A
caggaacuugaagcaaauguug

SEQ ID NO: 70636 - RNA, 19 nt, Artificial Sequence
  Synthetic Oligonucleotide; CD160 target exon 3; Set A
acuugaagcaaauguuggc

SEQ ID NO: 70637 - RNA, 20 nt, Artificial Sequence
  Synthetic Oligonucleotide; CD160 target exon 3; Set A
aacuugaagcaaauguuggc

SEQ ID NO: 70638 - RNA, 21 nt, Artificial Sequence
  Synthetic Oligonucleotide; CD160 target exon 3; Set A
caggaacuugaagcaaauguu

SEQ ID NO: 70639 - RNA, 20 nt, Artificial Sequence
  Synthetic Oligonucleotide; CD160 target exon 3; Set A
caggaacuugaagcaaaugu

SEQ ID NO: 70640 - RNA, 21 nt, Artificial Sequence
  Synthetic Oligonucleotide; CD160 target exon 3; Set A
aggaacuugaagcaaauguug

SEQ ID NO: 70641 - RNA, 18 nt, Artificial Sequence
  Synthetic Oligonucleotide; CD160 target exon 3; Set A
cuugaagcaaauguuggc

SEQ ID NO: 70642 - RNA, 20 nt, Artificial Sequence
  Synthetic Oligonucleotide; CD160 target exon 3; Set A
gaacuugaagcaaauguugg

SEQ ID NO: 70643 - RNA, 20 nt, Artificial Sequence
  Synthetic Oligonucleotide; CD160 target exon 3; Set A
ggaacuugaagcaaauguug

SEQ ID NO: 70644 - RNA, 20 nt, Artificial Sequence
  Synthetic Oligonucleotide; CD160 target exon 3; Set A
aggaacuugaagcaaauguu

SEQ ID NO: 70645 - RNA, 19 nt, Artificial Sequence
  Synthetic Oligonucleotide; CD160 target exon 3; Set A
aggaacuugaagcaaaugu

SEQ ID NO: 70646 - RNA, 19 nt, Artificial Sequence
  Synthetic Oligonucleotide; CD160 target exon 3; Set A
caggaacuugaagcaaaug

SEQ ID NO: 70647 - RNA, 19 nt, Artificial Sequence
  Synthetic Oligonucleotide; CD160 target exon 3; Set A
ggaacuugaagcaaauguu

SEQ ID NO: 70648 - RNA, 17 nt, Artificial Sequence
  Synthetic Oligonucleotide; CD160 target exon 3; Set A
uugaagcaaauguuggc

SEQ ID NO: 70649 - RNA, 18 nt, Artificial Sequence
  Synthetic Oligonucleotide; CD160 target exon 3; Set A
ggaacuugaagcaaaugu

SEQ ID NO: 70650 - RNA, 18 nt, Artificial Sequence
  Synthetic Oligonucleotide; CD160 target exon 3; Set A
acuugaagcaaauguugg

SEQ ID NO: 70651 - RNA, 16 nt, Artificial Sequence
  Synthetic Oligonucleotide; CD160 target exon 3; Set A
ugaagcaaauguuggc

SEQ ID NO: 70652 - RNA, 19 nt, Artificial Sequence
  Synthetic Oligonucleotide; CD160 target exon 3; Set A
aacuugaagcaaauguugg

SEQ ID NO: 70653 - RNA, 19 nt, Artificial Sequence
  Synthetic Oligonucleotide; CD160 target exon 3; Set A
gaacuugaagcaaauguug

SEQ ID NO: 70654 - RNA, 18 nt, Artificial Sequence
  Synthetic Oligonucleotide; CD160 target exon 3; Set A
aggaacuugaagcaaaug

SEQ ID NO: 70655 - RNA, 17 nt, Artificial Sequence
  Synthetic Oligonucleotide; CD160 target exon 3; Set A
cuugaagcaaauguugg

SEQ ID NO: 70656 - RNA, 18 nt, Artificial Sequence
  Synthetic Oligonucleotide; CD160 target exon 3; Set A
aacuugaagcaaauguug

SEQ ID NO: 70657 - RNA, 17 nt, Artificial Sequence
  Synthetic Oligonucleotide; CD160 target exon 3; Set A
acuugaagcaaauguug

SEQ ID NO: 70658 - RNA, 16 nt, Artificial Sequence
  Synthetic Oligonucleotide; CD160 target exon 3; Set A
uugaagcaaauguugg

SEQ ID NO: 70659 - RNA, 29 nt, Artificial Sequence
  Synthetic Oligonucleotide; CD160 target exon 3; Set A
gcacgcugucagcaggcccaggaacuuga

SEQ ID NO: 70660 - RNA, 25 nt, Artificial Sequence
  Synthetic Oligonucleotide; CD160 target exon 3; Set A
cugcacgcugucagcaggcccagga

SEQ ID NO: 70661 - RNA, 25 nt, Artificial Sequence
  Synthetic Oligonucleotide; CD160 target exon 3; Set A
ccugcacgcugucagcaggcccagg

SEQ ID NO: 70662 - RNA, 26 nt, Artificial Sequence
  Synthetic Oligonucleotide; CD160 target exon 3; Set A
gcacgcugucagcaggcccaggaacu

SEQ ID NO: 70663 - RNA, 27 nt, Artificial Sequence
  Synthetic Oligonucleotide; CD160 target exon 3; Set A
gcacgcugucagcaggcccaggaacuu

SEQ ID NO: 70664 - RNA, 24 nt, Artificial Sequence
  Synthetic Oligonucleotide; CD160 target exon 3; Set A
ugcacgcugucagcaggcccagga

SEQ ID NO: 70665 - RNA, 28 nt, Artificial Sequence
  Synthetic Oligonucleotide; CD160 target exon 3; Set A
gcacgcugucagcaggcccaggaacuug

SEQ ID NO: 70666 - RNA, 25 nt, Artificial Sequence
  Synthetic Oligonucleotide; CD160 target exon 3; Set A
gcacgcugucagcaggcccaggaac

SEQ ID NO: 70667 - RNA, 28 nt, Artificial Sequence
  Synthetic Oligonucleotide; CD160 target exon 3; Set A
cacgcugucagcaggcccaggaacuuga

SEQ ID NO: 70668 - RNA, 24 nt, Artificial Sequence
  Synthetic Oligonucleotide; CD160 target exon 3; Set A
gcacgcugucagcaggcccaggaa

SEQ ID NO: 70669 - RNA, 24 nt, Artificial Sequence
  Synthetic Oligonucleotide; CD160 target exon 3; Set A
cugcacgcugucagcaggcccagg

SEQ ID NO: 70670 - RNA, 34 nt, Artificial Sequence
  Synthetic Oligonucleotide; CD160 target exon 3; Set A
uguuggcucugcugguauccuuggcuucagucuc

SEQ ID NO: 70671 - RNA, 33 nt, Artificial Sequence
  Synthetic Oligonucleotide; CD160 target exon 3; Set A
uguuggcucugcugguauccuuggcuucagucu

SEQ ID NO: 70672 - RNA, 33 nt, Artificial Sequence
  Synthetic Oligonucleotide; CD160 target exon 3; Set A
guuggcucugcugguauccuuggcuucagucuc

SEQ ID NO: 70673 - RNA, 32 nt, Artificial Sequence
  Synthetic Oligonucleotide; CD160 target exon 3; Set A
guuggcucugcugguauccuuggcuucagucu

SEQ ID NO: 70674 - RNA, 23 nt, Artificial Sequence
  Synthetic Oligonucleotide; CD160 target exon 3; Set A
ugcacgcugucagcaggcccagg

SEQ ID NO: 70675 - RNA, 35 nt, Artificial Sequence
  Synthetic Oligonucleotide; CD160 target exon 3; Set A
auguuggcucugcugguauccuuggcuucagucuc

SEQ ID NO: 70676 - RNA, 34 nt, Artificial Sequence
  Synthetic Oligonucleotide; CD160 target exon 3; Set A
auguuggcucugcugguauccuuggcuucagucu

SEQ ID NO: 70677 - RNA, 27 nt, Artificial Sequence
  Synthetic Oligonucleotide; CD160 target exon 3; Set A
acgcugucagcaggcccaggaacuuga

SEQ ID NO: 70678 - RNA, 35 nt, Artificial Sequence
  Synthetic Oligonucleotide; CD160 target exon 3; Set A
cgcugucagcaggcccaggaacuugaagcaaaugu

SEQ ID NO: 70679 - RNA, 25 nt, Artificial Sequence
  Synthetic Oligonucleotide; CD160 target exon 3; Set A
cacgcugucagcaggcccaggaacu

SEQ ID NO: 70680 - RNA, 26 nt, Artificial Sequence
  Synthetic Oligonucleotide; CD160 target exon 3; Set A
cacgcugucagcaggcccaggaacuu

SEQ ID NO: 70681 - RNA, 27 nt, Artificial Sequence
  Synthetic Oligonucleotide; CD160 target exon 3; Set A
cacgcugucagcaggcccaggaacuug

SEQ ID NO: 70682 - RNA, 35 nt, Artificial Sequence
  Synthetic Oligonucleotide; CD160 target exon 3; Set A
acgcugucagcaggcccaggaacuugaagcaaaug

SEQ ID NO: 70683 - RNA, 26 nt, Artificial Sequence
  Synthetic Oligonucleotide; CD160 target exon 3; Set A
cgcugucagcaggcccaggaacuuga

SEQ ID NO: 70684 - RNA, 24 nt, Artificial Sequence
  Synthetic Oligonucleotide; CD160 target exon 3; Set A
cacgcugucagcaggcccaggaac

SEQ ID NO: 70685 - RNA, 24 nt, Artificial Sequence
  Synthetic Oligonucleotide; CD160 target exon 3; Set A
acgcugucagcaggcccaggaacu

SEQ ID NO: 70686 - RNA, 25 nt, Artificial Sequence
  Synthetic Oligonucleotide; CD160 target exon 3; Set A
acgcugucagcaggcccaggaacuu

SEQ ID NO: 70687 - RNA, 34 nt, Artificial Sequence
  Synthetic Oligonucleotide; CD160 target exon 3; Set A
cgcugucagcaggcccaggaacuugaagcaaaug

SEQ ID NO: 70688 - RNA, 26 nt, Artificial Sequence
  Synthetic Oligonucleotide; CD160 target exon 3; Set A
acgcugucagcaggcccaggaacuug

SEQ ID NO: 70689 - RNA, 24 nt, Artificial Sequence
  Synthetic Oligonucleotide; CD160 target exon 3; Set A
cgcugucagcaggcccaggaacuu

SEQ ID NO: 70690 - RNA, 23 nt, Artificial Sequence
  Synthetic Oligonucleotide; CD160 target exon 3; Set A
cgcugucagcaggcccaggaacu

SEQ ID NO: 70691 - RNA, 23 nt, Artificial Sequence
  Synthetic Oligonucleotide; CD160 target exon 3; Set A
acgcugucagcaggcccaggaac

SEQ ID NO: 70692 - RNA, 25 nt, Artificial Sequence
  Synthetic Oligonucleotide; CD160 target exon 3; Set A
cgcugucagcaggcccaggaacuug

SEQ ID NO: 70693 - RNA, 22 nt, Artificial Sequence
  Synthetic Oligonucleotide; CD160 target exon 3; Set A
cgcugucagcaggcccaggaac

SEQ ID NO: 70694 - RNA, 34 nt, Artificial Sequence
  Synthetic Oligonucleotide; CD160 target exon 3; Set A
caggaacuugaagcaaauguuggcucugcuggua

SEQ ID NO: 70695 - RNA, 33 nt, Artificial Sequence
  Synthetic Oligonucleotide; CD160 target exon 3; Set A
caggaacuugaagcaaauguuggcucugcuggu

SEQ ID NO: 70696 - RNA, 32 nt, Artificial Sequence
  Synthetic Oligonucleotide; CD160 target exon 3; Set A
ggaacuugaagcaaauguuggcucugcuggua

SEQ ID NO: 70697 - RNA, 31 nt, Artificial Sequence
  Synthetic Oligonucleotide; CD160 target exon 3; Set A
ggaacuugaagcaaauguuggcucugcuggu

SEQ ID NO: 70698 - RNA, 33 nt, Artificial Sequence
  Synthetic Oligonucleotide; CD160 target exon 3; Set A
aggaacuugaagcaaauguuggcucugcuggua

SEQ ID NO: 70699 - RNA, 32 nt, Artificial Sequence
  Synthetic Oligonucleotide; CD160 target exon 3; Set A
aggaacuugaagcaaauguuggcucugcuggu

SEQ ID NO: 70700 - RNA, 31 nt, Artificial Sequence
  Synthetic Oligonucleotide; CD160 target exon 3; Set A
gaacuugaagcaaauguuggcucugcuggua

SEQ ID NO: 70701 - RNA, 30 nt, Artificial Sequence
  Synthetic Oligonucleotide; CD160 target exon 3; Set A
gaacuugaagcaaauguuggcucugcuggu

SEQ ID NO: 70702 - RNA, 29 nt, Artificial Sequence
  Synthetic Oligonucleotide; CD160 target exon 3; Set A
acuugaagcaaauguuggcucugcuggua

SEQ ID NO: 70703 - RNA, 28 nt, Artificial Sequence
  Synthetic Oligonucleotide; CD160 target exon 3; Set A
acuugaagcaaauguuggcucugcuggu

SEQ ID NO: 70704 - RNA, 30 nt, Artificial Sequence
  Synthetic Oligonucleotide; CD160 target exon 3; Set A
aacuugaagcaaauguuggcucugcuggua

SEQ ID NO: 70705 - RNA, 28 nt, Artificial Sequence
  Synthetic Oligonucleotide; CD160 target exon 3; Set A
cuugaagcaaauguuggcucugcuggua

SEQ ID NO: 70706 - RNA, 29 nt, Artificial Sequence
  Synthetic Oligonucleotide; CD160 target exon 3; Set A
aacuugaagcaaauguuggcucugcuggu

SEQ ID NO: 70707 - RNA, 27 nt, Artificial Sequence
  Synthetic Oligonucleotide; CD160 target exon 3; Set A
cuugaagcaaauguuggcucugcuggu

SEQ ID NO: 70708 - RNA, 27 nt, Artificial Sequence
  Synthetic Oligonucleotide; CD160 target exon 3; Set A
uugaagcaaauguuggcucugcuggua

SEQ ID NO: 70709 - RNA, 27 nt, Artificial Sequence
  Synthetic Oligonucleotide; CD160 target exon 3; Set A
caggcccaggaacuugaagcaaauguu

SEQ ID NO: 70710 - RNA, 26 nt, Artificial Sequence
  Synthetic Oligonucleotide; CD160 target exon 3; Set A
ugaagcaaauguuggcucugcuggua

SEQ ID NO: 70711 - RNA, 26 nt, Artificial Sequence
  Synthetic Oligonucleotide; CD160 target exon 3; Set A
caggcccaggaacuugaagcaaaugu

SEQ ID NO: 70712 - RNA, 26 nt, Artificial Sequence
  Synthetic Oligonucleotide; CD160 target exon 3; Set A
uugaagcaaauguuggcucugcuggu

SEQ ID NO: 70713 - RNA, 25 nt, Artificial Sequence
  Synthetic Oligonucleotide; CD160 target exon 3; Set A
ugaagcaaauguuggcucugcuggu

SEQ ID NO: 70714 - RNA, 26 nt, Artificial Sequence
  Synthetic Oligonucleotide; CD160 target exon 3; Set A
aggcccaggaacuugaagcaaauguu

SEQ ID NO: 70715 - RNA, 25 nt, Artificial Sequence
  Synthetic Oligonucleotide; CD160 target exon 3; Set A
caggcccaggaacuugaagcaaaug

SEQ ID NO: 70716 - RNA, 18 nt, Artificial Sequence
  Synthetic Oligonucleotide; CD160 target exon 3; Set A
auguuggcucugcuggua

SEQ ID NO: 70717 - RNA, 17 nt, Artificial Sequence
  Synthetic Oligonucleotide; CD160 target exon 3; Set A
uguuggcucugcuggua

SEQ ID NO: 70718 - RNA, 17 nt, Artificial Sequence
  Synthetic Oligonucleotide; CD160 target exon 3; Set A
auguuggcucugcuggu

SEQ ID NO: 70719 - RNA, 16 nt, Artificial Sequence
  Synthetic Oligonucleotide; CD160 target exon 3; Set A
uguuggcucugcuggu

SEQ ID NO: 70720 - RNA, 16 nt, Artificial Sequence
  Synthetic Oligonucleotide; CD160 target exon 3; Set A
guuggcucugcuggua

SEQ ID NO: 70721 - RNA, 15 nt, Artificial Sequence
  Synthetic Oligonucleotide; CD160 target exon 3; Set A
guuggcucugcuggu

SEQ ID NO: 70722 - RNA, 24 nt, Artificial Sequence
  Synthetic Oligonucleotide; CD160 target exon 3; Set A
ccugcacgcugucagcaggcccag

SEQ ID NO: 70723 - RNA, 23 nt, Artificial Sequence
  Synthetic Oligonucleotide; CD160 target exon 3; Set A
cugcacgcugucagcaggcccag

SEQ ID NO: 70724 - RNA, 31 nt, Artificial Sequence
  Synthetic Oligonucleotide; CD160 target exon 3; Set A
cagccucugccggguuccaacagcauccugc

SEQ ID NO: 70725 - RNA, 22 nt, Artificial Sequence
  Synthetic Oligonucleotide; CD160 target exon 3; Set A
ugcacgcugucagcaggcccag

SEQ ID NO: 70726 - RNA, 30 nt, Artificial Sequence
  Synthetic Oligonucleotide; CD160 target exon 3; Set A
agccucugccggguuccaacagcauccugc

SEQ ID NO: 70727 - RNA, 30 nt, Artificial Sequence
  Synthetic Oligonucleotide; CD160 target exon 3; Set A
cagccucugccggguuccaacagcauccug

SEQ ID NO: 70728 - RNA, 29 nt, Artificial Sequence
  Synthetic Oligonucleotide; CD160 target exon 3; Set A
agccucugccggguuccaacagcauccug

SEQ ID NO: 70729 - RNA, 29 nt, Artificial Sequence
  Synthetic Oligonucleotide; CD160 target exon 3; Set A
cagccucugccggguuccaacagcauccu

SEQ ID NO: 70730 - RNA, 28 nt, Artificial Sequence
  Synthetic Oligonucleotide; CD160 target exon 3; Set A
agccucugccggguuccaacagcauccu

SEQ ID NO: 70731 - RNA, 32 nt, Artificial Sequence
  Synthetic Oligonucleotide; CD160 target exon 3; Set A
gauggccagggcacagcagccucugccggguu

SEQ ID NO: 70732 - RNA, 24 nt, Artificial Sequence
  Synthetic Oligonucleotide; CD160 target exon 3; Set A
ggguuccaacagcauccugcacgc

SEQ ID NO: 70733 - RNA, 23 nt, Artificial Sequence
  Synthetic Oligonucleotide; CD160 target exon 3; Set A
gguuccaacagcauccugcacgc

SEQ ID NO: 70734 - RNA, 23 nt, Artificial Sequence
  Synthetic Oligonucleotide; CD160 target exon 3; Set A
ggguuccaacagcauccugcacg

SEQ ID NO: 70735 - RNA, 19 nt, Artificial Sequence
  Synthetic Oligonucleotide; CD160 target exon 3; Set A
ccugcacgcugucagcagg

SEQ ID NO: 70736 - RNA, 22 nt, Artificial Sequence
  Synthetic Oligonucleotide; CD160 target exon 3; Set A
guuccaacagcauccugcacgc

SEQ ID NO: 70737 - RNA, 22 nt, Artificial Sequence
  Synthetic Oligonucleotide; CD160 target exon 3; Set A
gguuccaacagcauccugcacg

SEQ ID NO: 70738 - RNA, 18 nt, Artificial Sequence
  Synthetic Oligonucleotide; CD160 target exon 3; Set A
cugcacgcugucagcagg

SEQ ID NO: 70739 - RNA, 22 nt, Artificial Sequence
  Synthetic Oligonucleotide; CD160 target exon 3; Set A
ggguuccaacagcauccugcac

SEQ ID NO: 70740 - RNA, 18 nt, Artificial Sequence
  Synthetic Oligonucleotide; CD160 target exon 3; Set A
ccugcacgcugucagcag

SEQ ID NO: 70741 - RNA, 21 nt, Artificial Sequence
  Synthetic Oligonucleotide; CD160 target exon 3; Set A
guuccaacagcauccugcacg

SEQ ID NO: 70742 - RNA, 21 nt, Artificial Sequence
  Synthetic Oligonucleotide; CD160 target exon 3; Set A
gguuccaacagcauccugcac

SEQ ID NO: 70743 - RNA, 21 nt, Artificial Sequence
  Synthetic Oligonucleotide; CD160 target exon 3; Set A
ggguuccaacagcauccugca

SEQ ID NO: 70744 - RNA, 17 nt, Artificial Sequence
  Synthetic Oligonucleotide; CD160 target exon 3; Set A
cugcacgcugucagcag

SEQ ID NO: 70745 - RNA, 20 nt, Artificial Sequence
  Synthetic Oligonucleotide; CD160 target exon 3; Set A
guuccaacagcauccugcac

SEQ ID NO: 70746 - RNA, 20 nt, Artificial Sequence
  Synthetic Oligonucleotide; CD160 target exon 3; Set A
gguuccaacagcauccugca

SEQ ID NO: 70747 - RNA, 32 nt, Artificial Sequence
  Synthetic Oligonucleotide; CD160 target exon 3; Set A
uuggcucugcugguauccuuggcuucagucuc

SEQ ID NO: 70748 - RNA, 31 nt, Artificial Sequence
  Synthetic Oligonucleotide; CD160 target exon 3; Set A
uggcucugcugguauccuuggcuucagucuc

SEQ ID NO: 70749 - RNA, 30 nt, Artificial Sequence
  Synthetic Oligonucleotide; CD160 target exon 3; Set A
ggcucugcugguauccuuggcuucagucuc

SEQ ID NO: 70750 - RNA, 21 nt, Artificial Sequence
  Synthetic Oligonucleotide; CD160 target exon 3; Set A
gguauccuuggcuucagucuc

SEQ ID NO: 70751 - RNA, 20 nt, Artificial Sequence
  Synthetic Oligonucleotide; CD160 target exon 3; Set A
guauccuuggcuucagucuc

SEQ ID NO: 70752 - RNA, 31 nt, Artificial Sequence
  Synthetic Oligonucleotide; CD160 target exon 3; Set A
uuggcucugcugguauccuuggcuucagucu

SEQ ID NO: 70753 - RNA, 30 nt, Artificial Sequence
  Synthetic Oligonucleotide; CD160 target exon 3; Set A
uggcucugcugguauccuuggcuucagucu

SEQ ID NO: 70754 - RNA, 29 nt, Artificial Sequence
  Synthetic Oligonucleotide; CD160 target exon 3; Set A
ggcucugcugguauccuuggcuucagucu

SEQ ID NO: 70755 - RNA, 20 nt, Artificial Sequence
  Synthetic Oligonucleotide; CD160 target exon 3; Set A
gguauccuuggcuucagucu

SEQ ID NO: 70756 - RNA, 19 nt, Artificial Sequence
  Synthetic Oligonucleotide; CD160 target exon 3; Set A
guauccuuggcuucagucu

SEQ ID NO: 70757 - RNA, 30 nt, Artificial Sequence
  Synthetic Oligonucleotide; CD160 target exon 3; Set A
caggcccaggaacuugaagcaaauguuggc

SEQ ID NO: 70758 - RNA, 29 nt, Artificial Sequence
  Synthetic Oligonucleotide; CD160 target exon 3; Set A
aggcccaggaacuugaagcaaauguuggc

SEQ ID NO: 70759 - RNA, 29 nt, Artificial Sequence
  Synthetic Oligonucleotide; CD160 target exon 3; Set A
caggcccaggaacuugaagcaaauguugg

SEQ ID NO: 70760 - RNA, 28 nt, Artificial Sequence
  Synthetic Oligonucleotide; CD160 target exon 3; Set A
aggcccaggaacuugaagcaaauguugg

SEQ ID NO: 70761 - RNA, 28 nt, Artificial Sequence
  Synthetic Oligonucleotide; CD160 target exon 3; Set A
caggcccaggaacuugaagcaaauguug

SEQ ID NO: 70762 - RNA, 27 nt, Artificial Sequence
  Synthetic Oligonucleotide; CD160 target exon 3; Set A
aggcccaggaacuugaagcaaauguug

SEQ ID NO: 70763 - RNA, 34 nt, Artificial Sequence
  Synthetic Oligonucleotide; CD160 target exon 3; Set A
ccugcacgcugucagcaggcccaggaacuugaag

SEQ ID NO: 70764 - RNA, 33 nt, Artificial Sequence
  Synthetic Oligonucleotide; CD160 target exon 3; Set A
cugcacgcugucagcaggcccaggaacuugaag

SEQ ID NO: 70765 - RNA, 15 nt, Artificial Sequence
  Synthetic Oligonucleotide; CD160 target exon 3; Set A
uuggcucugcuggua

SEQ ID NO: 70766 - RNA, 33 nt, Artificial Sequence
  Synthetic Oligonucleotide; CD160 target exon 3; Set A
ccugcacgcugucagcaggcccaggaacuugaa

SEQ ID NO: 70767 - RNA, 32 nt, Artificial Sequence
  Synthetic Oligonucleotide; CD160 target exon 3; Set A
ugcacgcugucagcaggcccaggaacuugaag

SEQ ID NO: 70768 - RNA, 25 nt, Artificial Sequence
  Synthetic Oligonucleotide; CD160 target exon 3; Set A
aggcccaggaacuugaagcaaaugu

SEQ ID NO: 70769 - RNA, 24 nt, Artificial Sequence
  Synthetic Oligonucleotide; CD160 target exon 3; Set A
aggcccaggaacuugaagcaaaug

SEQ ID NO: 70770 - RNA, 23 nt, Artificial Sequence
  Synthetic Oligonucleotide; CD160 target exon 3; Set A
cacgcugucagcaggcccaggaa

SEQ ID NO: 70771 - RNA, 23 nt, Artificial Sequence
  Synthetic Oligonucleotide; CD160 target exon 3; Set A
gcacgcugucagcaggcccagga

SEQ ID NO: 70772 - RNA, 22 nt, Artificial Sequence
  Synthetic Oligonucleotide; CD160 target exon 3; Set A
acgcugucagcaggcccaggaa

SEQ ID NO: 70773 - RNA, 22 nt, Artificial Sequence
  Synthetic Oligonucleotide; CD160 target exon 3; Set A
cacgcugucagcaggcccagga

SEQ ID NO: 70774 - RNA, 22 nt, Artificial Sequence
  Synthetic Oligonucleotide; CD160 target exon 3; Set A
gcacgcugucagcaggcccagg

SEQ ID NO: 70775 - RNA, 21 nt, Artificial Sequence
  Synthetic Oligonucleotide; CD160 target exon 3; Set A
cgcugucagcaggcccaggaa

SEQ ID NO: 70776 - RNA, 21 nt, Artificial Sequence
  Synthetic Oligonucleotide; CD160 target exon 3; Set A
acgcugucagcaggcccagga

SEQ ID NO: 70777 - RNA, 21 nt, Artificial Sequence
  Synthetic Oligonucleotide; CD160 target exon 3; Set A
cacgcugucagcaggcccagg

SEQ ID NO: 70778 - RNA, 20 nt, Artificial Sequence
  Synthetic Oligonucleotide; CD160 target exon 3; Set A
cgcugucagcaggcccagga

SEQ ID NO: 70779 - RNA, 20 nt, Artificial Sequence
  Synthetic Oligonucleotide; CD160 target exon 3; Set A
acgcugucagcaggcccagg

SEQ ID NO: 70780 - RNA, 34 nt, Artificial Sequence
  Synthetic Oligonucleotide; CD160 target exon 3; Set A
ggguuccaacagcauccugcacgcugucagcagg

SEQ ID NO: 70781 - RNA, 33 nt, Artificial Sequence
  Synthetic Oligonucleotide; CD160 target exon 3; Set A
gguuccaacagcauccugcacgcugucagcagg

SEQ ID NO: 70782 - RNA, 33 nt, Artificial Sequence
  Synthetic Oligonucleotide; CD160 target exon 3; Set A
ggguuccaacagcauccugcacgcugucagcag

SEQ ID NO: 70783 - RNA, 32 nt, Artificial Sequence
  Synthetic Oligonucleotide; CD160 target exon 3; Set A
guuccaacagcauccugcacgcugucagcagg

SEQ ID NO: 70784 - RNA, 32 nt, Artificial Sequence
  Synthetic Oligonucleotide; CD160 target exon 3; Set A
gguuccaacagcauccugcacgcugucagcag

SEQ ID NO: 70785 - RNA, 31 nt, Artificial Sequence
  Synthetic Oligonucleotide; CD160 target exon 3; Set A
guuccaacagcauccugcacgcugucagcag

SEQ ID NO: 70786 - RNA, 35 nt, Artificial Sequence
  Synthetic Oligonucleotide; CD160 target exon 3; Set A
cagccucugccggguuccaacagcauccugcacgc

SEQ ID NO: 70787 - RNA, 34 nt, Artificial Sequence
  Synthetic Oligonucleotide; CD160 target exon 3; Set A
agccucugccggguuccaacagcauccugcacgc

SEQ ID NO: 70788 - RNA, 34 nt, Artificial Sequence
  Synthetic Oligonucleotide; CD160 target exon 3; Set A
cagccucugccggguuccaacagcauccugcacg

SEQ ID NO: 70789 - RNA, 33 nt, Artificial Sequence
  Synthetic Oligonucleotide; CD160 target exon 3; Set A
agccucugccggguuccaacagcauccugcacg

SEQ ID NO: 70790 - RNA, 33 nt, Artificial Sequence
  Synthetic Oligonucleotide; CD160 target exon 3; Set A
cagccucugccggguuccaacagcauccugcac

SEQ ID NO: 70791 - RNA, 32 nt, Artificial Sequence
  Synthetic Oligonucleotide; CD160 target exon 3; Set A
agccucugccggguuccaacagcauccugcac

SEQ ID NO: 70792 - RNA, 32 nt, Artificial Sequence
  Synthetic Oligonucleotide; CD160 target exon 3; Set A
cagccucugccggguuccaacagcauccugca

SEQ ID NO: 70793 - RNA, 31 nt, Artificial Sequence
  Synthetic Oligonucleotide; CD160 target exon 3; Set A
agccucugccggguuccaacagcauccugca

SEQ ID NO: 70794 - RNA, 21 nt, Artificial Sequence
  Synthetic Oligonucleotide; CD160 target exon 3; Set A
gcacgcugucagcaggcccag

SEQ ID NO: 70795 - RNA, 20 nt, Artificial Sequence
  Synthetic Oligonucleotide; CD160 target exon 3; Set A
cacgcugucagcaggcccag

SEQ ID NO: 70796 - RNA, 33 nt, Artificial Sequence
  Synthetic Oligonucleotide; CD160 target exon 3; Set A
ggauggccagggcacagcagccucugccggguu

SEQ ID NO: 70797 - RNA, 19 nt, Artificial Sequence
  Synthetic Oligonucleotide; CD160 target exon 3; Set A
acgcugucagcaggcccag

SEQ ID NO: 70798 - RNA, 32 nt, Artificial Sequence
  Synthetic Oligonucleotide; CD160 target exon 3; Set A
ggauggccagggcacagcagccucugccgggu

SEQ ID NO: 70799 - RNA, 31 nt, Artificial Sequence
  Synthetic Oligonucleotide; CD160 target exon 3; Set A
gauggccagggcacagcagccucugccgggu

SEQ ID NO: 70800 - RNA, 18 nt, Artificial Sequence
  Synthetic Oligonucleotide; CD160 target exon 3; Set A
cgcugucagcaggcccag

SEQ ID NO: 70801 - RNA, 31 nt, Artificial Sequence
  Synthetic Oligonucleotide; CD160 target exon 3; Set A
ggauggccagggcacagcagccucugccggg

SEQ ID NO: 70802 - RNA, 30 nt, Artificial Sequence
  Synthetic Oligonucleotide; CD160 target exon 3; Set A
gauggccagggcacagcagccucugccggg

SEQ ID NO: 70803 - RNA, 31 nt, Artificial Sequence
  Synthetic Oligonucleotide; CD160 target exon 3; Set A
auugccagcaggauggccagggcacagcagc

SEQ ID NO: 70804 - RNA, 17 nt, Artificial Sequence
  Synthetic Oligonucleotide; CD160 target exon 3; Set A
ugcacgcugucagcagg

SEQ ID NO: 70805 - RNA, 26 nt, Artificial Sequence
  Synthetic Oligonucleotide; CD160 target exon 3; Set A
cagggcacagcagccucugccggguu

SEQ ID NO: 70806 - RNA, 15 nt, Artificial Sequence
  Synthetic Oligonucleotide; CD160 target exon 3; Set A
gcacgcugucagcag

SEQ ID NO: 70807 - RNA, 21 nt, Artificial Sequence
  Synthetic Oligonucleotide; CD160 target exon 3; Set A
ggauggccagggcacagcagc

SEQ ID NO: 70808 - RNA, 20 nt, Artificial Sequence
  Synthetic Oligonucleotide; CD160 target exon 3; Set A
gauggccagggcacagcagc

SEQ ID NO: 70809 - RNA, 20 nt, Artificial Sequence
  Synthetic Oligonucleotide; CD160 target exon 3; Set A
ggauggccagggcacagcag

SEQ ID NO: 70810 - RNA, 23 nt, Artificial Sequence
  Synthetic Oligonucleotide; CTLA4; Set A
ggaagucagaaucugggcacggu

SEQ ID NO: 70811 - RNA, 26 nt, Artificial Sequence
  Synthetic Oligonucleotide; CTLA4; Set A
uaacugcugcaaggauccagaggagg

SEQ ID NO: 70812 - RNA, 22 nt, Artificial Sequence
  Synthetic Oligonucleotide; ADORA2A; Set A
ggcgcucuccaagggcuuuuuc

SEQ ID NO: 70813 - RNA, 29 nt, Artificial Sequence
  Synthetic Oligonucleotide; ADORA2A; Set A
gcaucauggcucagcccagcuucaggguu

SEQ ID NO: 70814 - RNA, 22 nt, Artificial Sequence
  Synthetic Oligonucleotide; PD-1; Set A
gacaccaaccaccaggguuugg

SEQ ID NO: 70815 - RNA, 18 nt, Artificial Sequence
  Synthetic Oligonucleotide; PD-1; Set A
cugggugaggggcugggg

SEQ ID NO: 70816 - RNA, 27 nt, Artificial Sequence
  Synthetic Oligonucleotide; PD-1; Set A
auugucccugcagagaaacacacuugg

SEQ ID NO: 70817 - RNA, 21 nt, Artificial Sequence
  Synthetic Oligonucleotide; PD-1; Set A
agugagacucaccaggggcug
